United States Patent 12,442,020 (MATERIALS AND METHODS FOR TREATMENT OF PAIN RELATED DISORDERS) - sequence listing, part 2

SEQ ID NO: 5304 - DNA, 190794 bp, Homo sapiens
  source 1..190794: mol_type = unassigned DNA
taggataaatccagagcaacgttagttaaagttaattcagccccactgctaagataagacccttctgcagagtctacccaatatctcctgtgttttgaggtcttttcactttgactggggaggataaaatattactatccctgtgtgaggtccaagaatttttaacctgctacttaagattacagtcatgtcagtcatgtgccagataacacttcagtcaaggacagactgcatatatgatggtggtcccacagattataatactgtatttttactgtaacttttctatgtttaggtatgattagacacaaaaataccactgtgttacaattgtctcagtacagtaacatgttgtacaggtttatagcctagaagcaataggctataccataaagactaagtatgtagtagactataccatctaggtttgtgtaagtactgtctctatgatgttaaaattgcctagtgacacatttctcggtacatatctccattgttaggcaatgcatgactgtagttctttctctggcttagggtatttttgttttcacacaattgcagaatgctgtcaagcaaaaacttgaggtctctttctacagatctctggtatactctctgttcagctcccttgtcttaggtgtcctgtcccaaataaacaaattctagctccctcagcctatcaaactcttattttctggctcttcatgtttccatcttcctgagctgtggtttagaaactttgtgtagtatgcagagacaatcacagcctcactttctttctcttctctagggatcactgtcttatagataatgttgcccaatgactgaaaactagtgtttcatatattttgtccccttatctaatggaagacttctacaagggaatgtcgataacaatagttttgatcaaaaataactccacagaaagcacattatcagcaaaaccattgttagggtaagggacccatcagtggactatgacactggggaaaattcttcaggaataagtaatcaattaatatacttactaagcatctactacatgcaagacaaaacatttatttttcttcacatcagttttctggccaaaaaaatccagaccacgtcaaattagacgagcaaacactcagatgccaatacatttaggaaacctcttttcttcagttgtttcattaagcatcatttgcccatctcatcactccaatctatgtctgataatcttcattgtatattctatttctttttagttataatttgaagttctacttttgaatcctactttttagctatgtatacacaaaacttgtaactttattcttctattttcacaacagaataattgttttttcttactttgtaatattgccgtgcagccaatattagaaggtaaaagtatttttctaatcctatttaattagagaaaaacaaactctttcagtattgtattaattttattgccttaatattactgtctattttttgttcttccagaaacttctacagttttgaaaattgcagtggcaattgtggaaaatacagaagtgtggatatccatttatttctcactaagggaaataaaattcttattcctattctggtatggattgtatgatgttagttaatttccatgactcaacatttccacatttttctatctaagttacggaaggtcagttgtaaatatgattaggaacttattggttattggctttttcaaccagacaggctttgtctggttcccttaattcaagcctaccctttaaattttaaacgtaccatctacttatgtctacatctgacgctgtcatttagtgtttaatgaactctcaaggctgtgcagtgtagtatttaataagaaatttggaaagatactttttctgggtttaaaccaagataaaatttctagggctgccaaaagagcaagaaaaacacaaacagctaatgttctgtagactaggaatggcacataaaagaaatggaaaggaaataaatagttggaacatgaaagaaaattgggaaaataatgaataatatacctaatgctttgcctatgagctcacagggaaaatcctgcaagggatccctcagtcagaccaagaggattttatttttggttttatcattttccaggattttatgtttgaagatctctaacaagaacctagatatattgagaatagtaagttcttgttaatggatgcttaaagtggaatatataatatgttatatattatatacaacatatgtattatacataacatatattataacataatatagtaatataatatataacatgttataatatataggttatatataatgtataatgcattatatattccactctaagaatgtatctaacatatgtgttattctagatataacagcaaaggcataatctataagagacataattgctaaggtgaactgcattaaaattaaaaacttctgctctgcaaaaacggacaacaagccagtgttagataaatatttgcaaaagacacatctgacaaatgactgttaaccaaaatatacaaataaagcttaaaactcaacaacaagaaaagaaataacccaatgaaaaaaatgggccatataccttaacagaccaaagaagatgcacatattgcaaataagcatataaaaaggtgatccacatcatatatcacaggggaaatgcaaatcaaataacacttatggtatcaacaatgggcatgagataccaccacatatgtattggaataaccaaaatccagaacactgatgatatcaagttctggccaaggatgtgaggcaacaggaactctcatgtattgctggtgggaatgcaaaatgctccagccactttgaggacagtgtagcagtttctttaaaaactaaacatactctcaccatatgatccagcaattgtgctccttgatgttcacccaaaggacttgaaaacatgtccacacagtaaccttcacaaagatgtttatagaggctttacgcataattgctaaaacttggaagcaaacaagatgtccttcagtaggtgaatgaataaactatggtaccaccagtcaatggaatattattcagcactgtaaagaaatgagctatcaagctatgaaaagccatggaggaaaactaaaagcatattgctaagtgaaaggagtcaatctgaaagggctatattctgtattattgcaactataggatatcctggagaaggcaaaactataaagacagtaaaatgatcagtacttgccaggggttgaaatgggagatgaataagtggaacacagagaattcaggagagaactgaaattactctgtaagatactgtaatggtggatacatgtcattatatatttgcctaaccccatagaatggacaacaccatgagctaaccctaaatgtgaactacagaccttgggagataatgaaacctcaaagtaagttcattaattttaacaaatgtttcattctggtggggaatgttgataatgggggaggctattcttgtgtgggagtagcggttatgtgggaaatctctgtaccctcccttcagttttgctgtgaacctaaaattgctctaaaaataaaattttaaaaataaaagaatgtggcattgcttgcatctaataaaaaagaccattattcctattgcagttgaactcttcttcctatatctaccaccaatcagggaagagaaggcgatttgtccaggatatggcactgagaattatcacaagtgagctagttcaccttcattgcacagtctcagtcactgaagtttccttccttcaatagcacatcttacaagtcaagaatgtaaggtccaaagccccaggacaaatctcagaagcaaagaaagcagcagggaaaagtagaccctgggatttgatttccttccggttatctctaagcatcatttccatgatagaaggtgtggaagcaaataataaaagtgcccgtcactagtgtttatcctgcaaagtggtctgcccttttgagaggcaccctgccctatggccatcctttgatttcttcccttggtggaaatttcctgtttctctttgagaaagataattcaaccctgtttccattgttcttcctcccaggctgctgtaggaaagcgcacgcacacactccacacaaaatgaatttttaaaaaatttattttcacagtcgctcctaccagctctgaaattcagaacccatatgactgatggcatattcagataatcgggtcccaggtctggaaaagcagccttttccccacgtttctttccccacctaggacctcctctgattcttcactgcatcttcgaaagaaaatgtattatttgcttgcctggaagacgctgcaattcaattgattttatatatacatatatataaagaaaacagaaaacatagcctagataccggtcttgagcgtcaccgccccactcgcggttgtgagcaaagccctacggaagaaaccaattcccagcctagactcttcagagcccaaggtcggggaggcgctggcctggcggtgttgtctggctccccagccactgccccagactcagggctttgccattggtccccacctcctctgctccggagtttttctccagctccccaccaagccacacaaagtgacttctcggaaacattagccgattctgctgagcaggaagggaggaaagggatgatgggggcgggggtgagataagggaagggctcttctggctgctggacacacacacacacacactcaaacacacacacgccccacccaatgggtggccgtggatggcaggtcgtgcaaccccctcctccgccttctattagcgcatggtgcagaggctacagcgtcgccaccaccgcgcccctagctgggtccccgccctgcgccgcccgcaggagtggagagagggagggagggagggagcaaggggtggggacccgggcgcgctgggaggagtggaggaggcaaagcggcgcagctgccctcggggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaattatgtttacacgtattttctgtttcagttagaataaccataggtgggtaaagtcagtggatatctaaataagttgcaacaactgatagctttttccttttcattgaaaggacagcttcaaatgtcctccataagaagtgttcccgggaaacaaagacaaggacaaagaatctagagttccaaagtaatttcttgaaatccacatcaaggtttgtgcaaagggagaaaattgagacaggaagcaaaaatatgcaaacatctagccacacagcgatgtctacatttttgtgtaatagcattaagaggtggtgtagcatacataatggctaagagctttggttcatggagactgcattgttcctgtatgacacagaagtagcctggattcttacatttttagtagcaaattggttgtcatactaactactattactactaatataaattcttgattctgtattgtcattgttctaatttctttgtgtagcttgtctcattctacccttacaaccacatggagtattactctttttctcattttacagatgggaaagctgtaccagctcttaagaggtgatatagcatacataatggctaagagcatgggttctaagactagaactatatttgtatcccagttaagccatgaccctatgagtttgctgaatacattctttaacctatatgggcctcaactttcttatctataaaatgaggagaagagtactacttcattatgtggttgtaatgatagaatgagacaagcttcatgaagaaattaaaacaatgactgaaaacacattgaaaatttatattagtagtaagagtagttagtatggcaattaatttgctactaaaaatgtaagaacccaggctacctctgtatcatacaggaacaatgcactcttcatgaatgttaaataatgacaatattttctctattttatatgggtaagtataactatagtgcccaaaagagttttatgcacccattggtaggtagtaaatatttagtgatgtggcatatacaccaaatatttcaaaatttagctacttttgagatttatgaattcaaacaacatattaaaatcaggaaatatgcacatttataaaggtctagcttatttccaaaaagtggaggtggttcttaccatttttagctgagtaattaatacaaccctctactttagctataagcatcaagtcctgttgatggtcattaggtaagatattctaaaaataattgccatactaggccattatttcaacttttatgttatcttaatagcatgtaaaaggtgtaaaatagtccttgggacttttgtactgatagttgcaatagccactctgcaaaatagaattataatcactgaataatactgtaatccatttcaacataagtgattgtgatacatgcaaattttttacaacaacaaagctaaattctttcacattgtagataatgctatgccataacccaagcaaaatgagctgcaggatacatggtaatctctctcaagggagggagaaattacatactagctagagcagaggggattttgctgcaatagtatttgatgcacacaggaaatgaaacatgaataattgatagttataaacaagcaatagagctcacatgctacacttagcttgactccctattactctgcgagccatacctacattaataattgatctgtctgcgaaaaggtaatttgaagagatttatgagacattggtaataactgcatcattgcactttagcttgaatctttttaaatatatctttagaaacaaaagataaaagcaatgcacaataagtatacagaaaatgttcagagcttgttaaaaattttgcaaatctagtagaactgagcaaaagttattcgtaagttgtaatatttgctggcatgacctagtttttattttatttcctacaaaacaatatgtcttcaagttagttcagtcatattctttctataaaaatataattcttctctaatataccatcataattcatttttatttttagtgatgtgtaaaatttagaatttatgggaaaattatatccagtgaatattaagaatacactcccattaaattactatttctaaatatgtgagaacataatctggatttgcatgtgctgctttaaacaaatacattcttttacttatggctggcccttcatctgaggagcctccagatttactctctttaaatatcttgtgtcttctactctgtacattgacaatatgttaaaatgtgctttctcctgttcttaggctactcttgagaactgctcatttttatatgagaaagaatgatatcttgctcatataagaaaaggatataaaccaactgtgatacactaattccttctaacagaacagaaaaaataagtggatggggttacatgtgtctttatacaaaacacagataactatacccaggctcctgcctcacaaaaattgtgagataatacatttgtattattttaagctgctaaatttgtgatcatttgttacaaaggatcaaacacaaatgcatgctcctgttttccaatgtaccatgttaaggtagaaatacagatgagcaacgctactagaaaggttattttatcaaaccacaatggctcatacagactgtggaggtaaaaagagagggacactggtgagacagtttggcacactgatctcgcccgcaaaagactgatgtagaaagcaaatgttaattgttatcttatcaaaaatttaaaggaggagattttcctccctgttgactatcctaatcgtgtttaccattcagtgcaccttattcttggcaaagcaccttacaaatttttacccagaagccaaagaaaatgggcaatcttaagtaattttctcaaagtcaaagagaatctgaagtatacttgtcccactcatgcctttaaaatgtaggccaagagaatctacagcaaatgtcttctaaaacgtttcatttggaacataaaaagtttctatgtcaatacatttaaggaagggtgcattatatatttcactcttagagtaacataattcactttagcatgttacatgcttgcagaagacatgagactcaggagtcagagataataatagattattacttaaagcaatagcaggagccagagtattatcatttttgtgttggtcttagaaagctggggctgtcataataatataccatagactgggtggctagaacaacagaaatttatttctaacagttcccgaggctgaggagtccaagattaaggcgccagccaatttcgttccccagtgagggctcatttcctggctggcagagggcagcattctcactgtgtcttcaaatggaggaggcagtgagctctggtctctcttcttttttctataggaatactaatctcatggtggaagatatatatatatatatatatatatatatgtatatatatatgtgtgtatatatatatatatacatatatatatatgtgtgtgtatatatatatatatatatatatatatatatatatgcattcagtcctccatatccatggtttctgatctgtggattcaaccaattctggatcagaaatagttggggaaaaaatccacaaagccccaaaaggcaaaacttgaattttccatatgctgagtactacattgaatccatacaaatgaagtgatgtgtaggtaattttaaactatataggaggatgtgtgtaggttataagcaaacactatgccatttgtataagagatttgagcatctgtggattttggtattctcagggagtccagaagccaatccccagcagatactaagggacaactgtatatcatggtaaataaattacatcttccttctcattgattagtaccaccattcatccagttttccaaactaatcctcttcattaaccctccgcatttattcaccaagaccagttcattctaccacctaatgtaatgtaaatacatcaacttctcttaatttccactgtcaacacctaatccaatccattaccacctttaacctctttataagacaatgtaataacctacttgttttatcttactaaatccattcttgcctcacttccaaatctattctcagtacagtagccagagtggattttatgaggttgtgacatttccctgcttaaaattttgggtcattttccggcataaaattctgtaatatttctccattattatgatgataaattctaaaatcctcagcaaagattttacaaactctatactattactgtctacaagttctacaagctttccagccctacaccatgtcagcctcactgctcttatcttccctctttccctatcttaatctgtgtgcttcagcctcaatagttttctttctgtttgcaggatcttctcaacaaaagtatagtgtattcttacattcttatacagtgccagtgctttctggcctgagagagactatacatgtctttcacatggtaagttgagtggatgtttgaaactgtcccactgctcacaaaataaaattagtatagaaaactggcatttttgaaggactaagttaaaagtgtttttcctctatagctttaacaaagtagaaaaaaaacagagataatgtcaagtaggaaataaagactgaaaaatgaaaactttcatatacattctacattaaaatcagacatttatttctctaaggcctgagtttctcaatattggcaatcttgatatttgagctggataattctttgttgtgagtggctgtcctgtgcatggtgggatgtttagcacgatcactggtctctaacctctagatatcaataaacattcctaattccacagttatgacaaataaaaatgtccccatctttgctaaatgttctcagggggacaaaatcttccccagttgacaacgactgatctctgacaatgtctataaaagtatgaatcatggataaccgacattaccttagctattagttt

SEQ ID NO: 5305 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ggaaataaagactgaaaaat

SEQ ID NO: 5306 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tagctttaacaaagtagaaa

SEQ ID NO: 5307 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
cacaaaataaaattagtata

SEQ ID NO: 5308 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
atccacaaagccccaaaagg

SEQ ID NO: 5309 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aatctacagcaaatgtcttc

SEQ ID NO: 5310 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gggttacatgtgtctttata

SEQ ID NO: 5311 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
agtttttattttatttccta

SEQ ID NO: 5312 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aagaaattaaaacaatgact

SEQ ID NO: 5313 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gacaagcttcatgaagaaat

SEQ ID NO: 5314 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tatgttattatcttcttgag

SEQ ID NO: 5315 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tggaagcaaacaggttttct

SEQ ID NO: 5316 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
catttgtcctaatctacgta

SEQ ID NO: 5317 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gaggttttgaagcaaatata

SEQ ID NO: 5318 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ctgtagacatctagtttttt

SEQ ID NO: 5319 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tacatattacactcctcaaa

SEQ ID NO: 5320 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ataaatcagaagaccatgta

SEQ ID NO: 5321 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aagtgatttatttgtgttaa

SEQ ID NO: 5322 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aatgagaactcaagtccaga

SEQ ID NO: 5323 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tgaacccatcacaaccacac

SEQ ID NO: 5324 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ggatcctcctcttctcatag

SEQ ID NO: 5325 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ataagaaatgagttgacaga

SEQ ID NO: 5326 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aaaaaaaaaaaaaaaaaaaa

SEQ ID NO: 5327 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taggtatcattcttaaaatg

SEQ ID NO: 5328 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aggtgaaaaccgtccctacc

SEQ ID NO: 5329 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
accagcctggccaacaaggt

SEQ ID NO: 5330 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gtcatgaaaattttttggta

SEQ ID NO: 5331 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ccaataaggatacaaaataa

SEQ ID NO: 5332 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctaagccaaaaacagaagtt

SEQ ID NO: 5333 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ggcaaataccaaactaagcc

SEQ ID NO: 5334 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aagaagaaatgactgcacaa

SEQ ID NO: 5335 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ctcttatagtcctttctatg

SEQ ID NO: 5336 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taagacatatagatgttaaa

SEQ ID NO: 5337 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agtgtgggtaataaatagac

SEQ ID NO: 5338 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tatcatatgagacttctgaa

SEQ ID NO: 5339 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aaacagagaggtacatatat

SEQ ID NO: 5340 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tggccaatgcaattagataa

SEQ ID NO: 5341 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttatatatagctgtgtcttg

SEQ ID NO: 5342 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
agtttccaatattacctttg

SEQ ID NO: 5343 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aatgaaaaaatcctaaaaag

SEQ ID NO: 5344 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tttcactggagaatgtgtgc

SEQ ID NO: 5345 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaagataaaagtacatagtt

SEQ ID NO: 5346 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
taagttctagggtacatgtg

SEQ ID NO: 5347 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agatttaggcttttccagtc

SEQ ID NO: 5348 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gtagaatatacataaatctg

SEQ ID NO: 5349 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
acaacaacaacaacaacaac

SEQ ID NO: 5350 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cctcagagcaagactccatc

SEQ ID NO: 5351 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
atcacttgaggccaggagtt

SEQ ID NO: 5352 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taaatagaggaaagctgaat

SEQ ID NO: 5353 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
caaccaggatatcattaggg

SEQ ID NO: 5354 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ctaaataagctataggaaaa

SEQ ID NO: 5355 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aaggcctaaataagctatag

SEQ ID NO: 5356 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atgtagattgtaacacagaa

SEQ ID NO: 5357 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaattagtttttaataatca

SEQ ID NO: 5358 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttgaaatgcctgtttgattt

SEQ ID NO: 5359 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
acacaatgtcacaaaggaca

SEQ ID NO: 5360 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agattcagccaatgctgatt

SEQ ID NO: 5361 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttcaacttcttaacagttgt

SEQ ID NO: 5362 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttgtctattttatctttcga

SEQ ID NO: 5363 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aagttgggttctacaaaatg

SEQ ID NO: 5364 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
atcgttttttgtacttgaga

SEQ ID NO: 5365 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ctgagagtgctcaggcagtt

SEQ ID NO: 5366 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agaaccacagggagcggctg

SEQ ID NO: 5367 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tttaatcttcttaaatttgt

SEQ ID NO: 5368 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gtttcatgtcatcatgaaca

SEQ ID NO: 5369 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttcgattttatcttttcaa

SEQ ID NO: 5370 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ggattttttactatttctgt

SEQ ID NO: 5371 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
attgcagcaaaagtaatggt

SEQ ID NO: 5372 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttgtgcttatttatggggta

SEQ ID NO: 5373 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
actcatttattccaaagaaa

SEQ ID NO: 5374 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttctttccactcttccctga

SEQ ID NO: 5375 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gttactgatttagaagcatc

SEQ ID NO: 5376 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aagagcagtatgagcataaa

SEQ ID NO: 5377 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gaataggaaatatgttccat

SEQ ID NO: 5378 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ataatacaaacctgagggct

SEQ ID NO: 5379 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aaatcaatacactatttatt

SEQ ID NO: 5380 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
atcttattcatttttgcaca

SEQ ID NO: 5381 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
cttttactgtttttacagtt

SEQ ID NO: 5382 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttgtggtaacattaaacaga

SEQ ID NO: 5383 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aatggacatgttgaatacag

SEQ ID NO: 5384 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ataaaatactgtgtggtttt

SEQ ID NO: 5385 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttagtcaaaatgtgcgatgg

SEQ ID NO: 5386 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tagagtaataataataaatt

SEQ ID NO: 5387 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aaataaagaaaggattaaag

SEQ ID NO: 5388 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ccacaggaattgccctggat

SEQ ID NO: 5389 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gtgtcaggtgttgtgatata

SEQ ID NO: 5390 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tcattactcacattttttag

SEQ ID NO: 5391 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tctatcacaactttccccta

SEQ ID NO: 5392 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tataactaaattatatttga

SEQ ID NO: 5393 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttaatggggtttaaaatat

SEQ ID NO: 5394 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
attgtgatttttctcccatg

SEQ ID NO: 5395 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ctacatgaggatgagcactt

SEQ ID NO: 5396 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gacaaacattcaaaccacag

SEQ ID NO: 5397 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tatgcatatattccgtgtca

SEQ ID NO: 5398 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tgaaggatggtctcaaaact

SEQ ID NO: 5399 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttgttcttgaaggatggtct

SEQ ID NO: 5400 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cacacaacatattaaatgtt

SEQ ID NO: 5401 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atctcagacccaattatagg

SEQ ID NO: 5402 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aatgtcattcttgttaagaa

SEQ ID NO: 5403 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
attcttactgtgtgttgtga

SEQ ID NO: 5404 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaatggatagcatatggtta

SEQ ID NO: 5405 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tattgataccaacagtttcc

SEQ ID NO: 5406 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ctcagaaagaagagtataca

SEQ ID NO: 5407 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aattccttgttcaaaatgtc

SEQ ID NO: 5408 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tcttgtgtgttataaaaagg

SEQ ID NO: 5409 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
catcagatattcaggaaatt

SEQ ID NO: 5410 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tatacaatcgtaaggaggca

SEQ ID NO: 5411 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gtttcctcagaagctataga

SEQ ID NO: 5412 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttactggcaatatcagtttg

SEQ ID NO: 5413 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aaaatctggtggaacatcag

SEQ ID NO: 5414 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aactaactaacaactattta

SEQ ID NO: 5415 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gacaagaatacattgtaagc

SEQ ID NO: 5416 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tctgtttttatctacctaac

SEQ ID NO: 5417 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tactctttttgtgtgacctc

SEQ ID NO: 5418 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aagcaattatttgcaaatca

SEQ ID NO: 5419 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gctctgtttatcacttctta

SEQ ID NO: 5420 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
attatctgaagttgttactt

SEQ ID NO: 5421 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aaacatgaaaagattcatta

SEQ ID NO: 5422 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cataaaatatacatgataac

SEQ ID NO: 5423 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cttagaaacttccagagaga

SEQ ID NO: 5424 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cttgggatatacctttgcac

SEQ ID NO: 5425 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tttttactgaagataaatgt

SEQ ID NO: 5426 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ggattgaacattgggtgctt

SEQ ID NO: 5427 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gtctccaacaaacaaacaaa

SEQ ID NO: 5428 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ggatatgcataacatttggg

SEQ ID NO: 5429 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gagggagatggagctgtgaa

SEQ ID NO: 5430 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
caaaccaaaaaatgacttca

SEQ ID NO: 5431 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttgaaaagcaaaaacaaaaa

SEQ ID NO: 5432 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttttttgaaaagcaaaaac

SEQ ID NO: 5433 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttttttttttttgaaaagc

SEQ ID NO: 5434 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tcatcaccatctgttgtttg

SEQ ID NO: 5435 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aatctactcactaactctca

SEQ ID NO: 5436 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ggtcattggcattttgattt

SEQ ID NO: 5437 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctcataaagctctgggtgag

SEQ ID NO: 5438 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tatgctgctttactccttta

SEQ ID NO: 5439 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
attttaaaacttatatattt

SEQ ID NO: 5440 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tcctggattaatctgtattt

SEQ ID NO: 5441 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aggtcaggaattgaagccat

SEQ ID NO: 5442 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttcctctcactgctttacct

SEQ ID NO: 5443 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aagttgttaccagctcagag

SEQ ID NO: 5444 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aatgctctcttaaacagtga

SEQ ID NO: 5445 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aattgaccattaaaaaaaca

SEQ ID NO: 5446 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tgaattcaattgaccattaa

SEQ ID NO: 5447 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aatacttaatgcattcccaa

SEQ ID NO: 5448 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tatatttcaccgcaggaaaa

SEQ ID NO: 5449 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atgatcttccttgtatagta

SEQ ID NO: 5450 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttcatttccaaaattacatg

SEQ ID NO: 5451 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ctatatcactttcatatttt

SEQ ID NO: 5452 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agcttcaaggcaatcaaagg

SEQ ID NO: 5453 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tctactcaagcagtatagta

SEQ ID NO: 5454 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
acaattatagatattgaccg

SEQ ID NO: 5455 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tattaatgacctccaatttt

SEQ ID NO: 5456 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taaattagtggaagtaacat

SEQ ID NO: 5457 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aatggtcatcctcttaagaa

SEQ ID NO: 5458 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
attatctatataggtataga

SEQ ID NO: 5459 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttagaggcaatattctcata

SEQ ID NO: 5460 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ctattgtgcaatgatgaaag

SEQ ID NO: 5461 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
cacatttaaattaagtagat

SEQ ID NO: 5462 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
attgaagctacatttaattt

SEQ ID NO: 5463 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tcttgcatgctgttcagcta

SEQ ID NO: 5464 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gtatatgactttaaacattt

SEQ ID NO: 5465 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
atttaaggaaaaatagaatg

SEQ ID NO: 5466 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttggatttgtttacgtgcct

SEQ ID NO: 5467 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agtcccccaaaaaccacact

SEQ ID NO: 5468 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctataaatattgagtccccc

SEQ ID NO: 5469 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tccaaccatttttaatctgc

SEQ ID NO: 5470 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atattttaagttaaataata

SEQ ID NO: 5471 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
catattgtataaaattacca

SEQ ID NO: 5472 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
cccacttgcctgaggaaggg

SEQ ID NO: 5473 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aacattctgttttcatattt

SEQ ID NO: 5474 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
acattcattcttctctaggt

SEQ ID NO: 5475 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttcccttctttattgaaaag

SEQ ID NO: 5476 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ggtgtttaaatttgtttctt

SEQ ID NO: 5477 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
acaaccctctggagtagttc

SEQ ID NO: 5478 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
cggctgttgtaacaaattag

SEQ ID NO: 5479 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaataaccaaagagatgagt

SEQ ID NO: 5480 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
caaatcaaaatattttacag

SEQ ID NO: 5481 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tccctctcttctccctaccc

SEQ ID NO: 5482 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctgcattttgagcaagggga

SEQ ID NO: 5483 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aacaactcaacaacgacaaa

SEQ ID NO: 5484 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tctgataatgggttaatatc

SEQ ID NO: 5485 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taggcaaggatttttttgga

SEQ ID NO: 5486 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cacaactattagagaagaaa

SEQ ID NO: 5487 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gactacttaaatgtaagact

SEQ ID NO: 5488 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
caaacagaatgatactgaca

SEQ ID NO: 5489 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ggcttcacactaactgactt

SEQ ID NO: 5490 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aggtgaaatatatttacaat

SEQ ID NO: 5491 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atatcaacagaatgaaacat

SEQ ID NO: 5492 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gactgtatcatgaagaaatg

SEQ ID NO: 5493 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aatcatactccaacaaattg

SEQ ID NO: 5494 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
taagaccttgagcaatttac

SEQ ID NO: 5495 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
attaagctgtggtcaactat

SEQ ID NO: 5496 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ctctttgtccatttgaaaca

SEQ ID NO: 5497 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gcagacagttgctctcagaa

SEQ ID NO: 5498 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aagtaatactcccaaaattt

SEQ ID NO: 5499 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaatggcacaatgtttacca

SEQ ID NO: 5500 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tacataagattaaattaaat

SEQ ID NO: 5501 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
atgaatttatagtggacttg

SEQ ID NO: 5502 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
cattgagaacaggaactctt

SEQ ID NO: 5503 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tctctctcttctttttttta

SEQ ID NO: 5504 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aagatctgaatactaagaag

SEQ ID NO: 5505 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaaaataattaactcagaaa

SEQ ID NO: 5506 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttccttttttgtttcctgga

SEQ ID NO: 5507 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttaggtcttacttcgatttt

SEQ ID NO: 5508 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
atcttcaccaatattcctat

SEQ ID NO: 5509 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gttaaggaccataggtttag

SEQ ID NO: 5510 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ggcaatatagatttatagta

SEQ ID NO: 5511 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tattatttagggtggaagac

SEQ ID NO: 5512 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttgggaaaggtataacttgt

SEQ ID NO: 5513 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tcttccttatactgattagt

SEQ ID NO: 5514 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttgtctgatcttaacaatat

SEQ ID NO: 5515 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aagatcaaattgttatcccc

SEQ ID NO: 5516 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gacaaatgcacttaaagaac

SEQ ID NO: 5517 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttggttttgcattattttt

SEQ ID NO: 5518 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ctttgcagctgaaatggtat

SEQ ID NO: 5519 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctgttttctaatattaacag

SEQ ID NO: 5520 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gacttaatgaaacaagcttt

SEQ ID NO: 5521 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
atcatcaacatcattgtcat

SEQ ID NO: 5522 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
acacacctcacatattttca

SEQ ID NO: 5523 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gaaaaatatgcatattggtg

SEQ ID NO: 5524 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cttattgttgtcatgggact

SEQ ID NO: 5525 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
atttaatagtaattgatgca

SEQ ID NO: 5526 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
actttgcaaaatgaaaaaaa

SEQ ID NO: 5527 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttatccccattttaccaata

SEQ ID NO: 5528 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gtttgacagactatagcaca

SEQ ID NO: 5529 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gcacaatatatggtttatat

SEQ ID NO: 5530 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aaatcctaaagtgaaaacta

SEQ ID NO: 5531 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
atcacaataaatcctaaagt

SEQ ID NO: 5532 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gacacaaacaaacataaaag

SEQ ID NO: 5533 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttcatctggagtctatgaat

SEQ ID NO: 5534 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttgtaatgcttcattggtt

SEQ ID NO: 5535 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tcattggtatgattttaggt

SEQ ID NO: 5536 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
cattctgatcattgtgtaaa

SEQ ID NO: 5537 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gctttatttcaacctgagac

SEQ ID NO: 5538 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tacattccaaaattaccttg

SEQ ID NO: 5539 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aattttttagtgtttataaa

SEQ ID NO: 5540 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tgtcacaaggatttttaaga

SEQ ID NO: 5541 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
actcttctatggggtatgac

SEQ ID NO: 5542 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tagacgctgcgtgctgctgg

SEQ ID NO: 5543 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aaattgaaataatttactaa

SEQ ID NO: 5544 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gtttaattttcctctaatcc

SEQ ID NO: 5545 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agcaaactaaaacaggaaca

SEQ ID NO: 5546 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaccatcattctcagcaaac

SEQ ID NO: 5547 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gccattagagaaatgcaatt

SEQ ID NO: 5548 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tacctaatgcatgcaggtct

SEQ ID NO: 5549 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agcaaactaatacaggaaga

SEQ ID NO: 5550 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gatcattaagaaacgcaaat

SEQ ID NO: 5551 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agaagacatttatgcggcca

SEQ ID NO: 5552 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
taatgacccaagattactgg

SEQ ID NO: 5553 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tactgaaccaagaactatca

SEQ ID NO: 5554 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atttatttaatggcatcagg

SEQ ID NO: 5555 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aatttcaggtcttctttctg

SEQ ID NO: 5556 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ggtagaaaatgttacttcta

SEQ ID NO: 5557 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taaacataaaggaggtctca

SEQ ID NO: 5558 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tgaaaagtaagataatttta

SEQ ID NO: 5559 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttaatcttgaaaattaattt

SEQ ID NO: 5560 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttaatagagaaagttttga

SEQ ID NO: 5561 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
atactgtggttatattgggc

SEQ ID NO: 5562 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cactgtctcacctcctgctg

SEQ ID NO: 5563 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aaataatgaagccaagagaa

SEQ ID NO: 5564 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ggtatgggtttaaagaatgg

SEQ ID NO: 5565 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agaaaaagggagtgacgcac

SEQ ID NO: 5566 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aaaaatagaagccttaacaa

SEQ ID NO: 5567 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tattaggttgaaataatgct

SEQ ID NO: 5568 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aaccatttgctgtaatatat

SEQ ID NO: 5569 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttttgaaagaaagacataaa

SEQ ID NO: 5570 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttcagagttctccgagcatt

SEQ ID NO: 5571 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttcagagtattgagagcttt

SEQ ID NO: 5572 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
catctgctacctgctgctaa

SEQ ID NO: 5573 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aaacctataagaagcacaca

SEQ ID NO: 5574 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
agttcttgtttaaaaatgaa

SEQ ID NO: 5575 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ttcatagtattgaacaaagg

SEQ ID NO: 5576 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aggaaaataaaaggacacct

SEQ ID NO: 5577 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gaatggcaggggaggcctca

SEQ ID NO: 5578 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tctaggaagttccttgaata

SEQ ID NO: 5579 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tcagagctttgtccatttca

SEQ ID NO: 5580 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tattacataagtttagttgg

SEQ ID NO: 5581 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
acacatgaatgataagaaaa

SEQ ID NO: 5582 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agtgaacacatgaatgataa

SEQ ID NO: 5583 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tatttttcactacattcttt

SEQ ID NO: 5584 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cagttgaatgtagaatctac

SEQ ID NO: 5585 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aaactaaatgcctgactaat

SEQ ID NO: 5586 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tgtggatgccttccactttt

SEQ ID NO: 5587 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
attttctttcttctggatag

SEQ ID NO: 5588 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agtgggtaagatagtaatga

SEQ ID NO: 5589 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
catagatggataagcataga

SEQ ID NO: 5590 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tatgtatgtatttttcattt

SEQ ID NO: 5591 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
ataggaagattgatattgtt

SEQ ID NO: 5592 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttttggaaaacagcagataa

SEQ ID NO: 5593 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tttaaaacagtagtattttg

SEQ ID NO: 5594 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aacataagtgaaagggattt

SEQ ID NO: 5595 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gacatgcttatgctcttccc

SEQ ID NO: 5596 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttttctctccttttgaataa

SEQ ID NO: 5597 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
cttcaaaccaaacaaaatcc

SEQ ID NO: 5598 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aagtaaatattaaaacattg

SEQ ID NO: 5599 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gagaattaaaaagtaaatat

SEQ ID NO: 5600 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gagggatgagtgagtatgag

SEQ ID NO: 5601 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gaatacgtgttcattatgtg

SEQ ID NO: 5602 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
taagtagtgaatccagtatt

SEQ ID NO: 5603 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gcaagtcttcatataaagtt

SEQ ID NO: 5604 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taccaggcacacagagtctc

SEQ ID NO: 5605 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
agaggctcagtgatggaatg

SEQ ID NO: 5606 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ggcgcatttgtcacaattaa

SEQ ID NO: 5607 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
cccaggcatgattactttaa

SEQ ID NO: 5608 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
agactaggggaagagtaaga

SEQ ID NO: 5609 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gtcagggactacaaaggcta

SEQ ID NO: 5610 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
catgtaaccaatactgggat

SEQ ID NO: 5611 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ctgggtgatgaaataagctg

SEQ ID NO: 5612 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aagtgagacacatagagggg

SEQ ID NO: 5613 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttcagaaaaagaagttttt

SEQ ID NO: 5614 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ctatatagttttgaaaacca

SEQ ID NO: 5615 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
attttaacctatatagtttt

SEQ ID NO: 5616 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ggttgctaagcatgggaatg

SEQ ID NO: 5617 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gtacaatattcaattttcaa

SEQ ID NO: 5618 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aatcatagtgcttagtaaat

SEQ ID NO: 5619 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gaagtggaatagtttcgtcc

SEQ ID NO: 5620 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttgtataagccacagatcca

SEQ ID NO: 5621 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ccattaccaaaaacaagttg

SEQ ID NO: 5622 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aaaattttcatgccattacc

SEQ ID NO: 5623 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
gaaatgctttaatcacttag

SEQ ID NO: 5624 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
acatctgtgatttcattttt

SEQ ID NO: 5625 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
taagattaagactgttctgt

SEQ ID NO: 5626 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aattttataagtcaactctg

SEQ ID NO: 5627 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tctaatcctgaaaaataaaa

SEQ ID NO: 5628 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tagctaatattgaaaatggt

SEQ ID NO: 5629 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tggatgtgcattaaacaaag

SEQ ID NO: 5630 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
taggaaataatgacaagaaa

SEQ ID NO: 5631 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctctcagaagatatagaact

SEQ ID NO: 5632 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
acactggaatgattacaact

SEQ ID NO: 5633 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tttatgtacacgtctttctt

SEQ ID NO: 5634 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agctcacaataaaaaattta

SEQ ID NO: 5635 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tgtcaggtcacgaaagaaaa

SEQ ID NO: 5636 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
atttctgcattttaaagttt

SEQ ID NO: 5637 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tttattggggtgaaagagaa

SEQ ID NO: 5638 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
taaaatggcatgttttgaaa

SEQ ID NO: 5639 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
agtagtagtagttgagaaag

SEQ ID NO: 5640 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gcctgatttttaaaaaattc

SEQ ID NO: 5641 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aaaaaagaaagagaaagaaa

SEQ ID NO: 5642 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ccatttctataaaaaataga

SEQ ID NO: 5643 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttggctaaactagtgccttt

SEQ ID NO: 5644 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tatcctagtattcttaaggt

SEQ ID NO: 5645 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttattctgcaagtatgctta

SEQ ID NO: 5646 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aacacttaattataaggatg

SEQ ID NO: 5647 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctctaatggtttaatcttta

SEQ ID NO: 5648 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctcaatgcactctatgtgct

SEQ ID NO: 5649 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tgttgaaagaatgctagttt

SEQ ID NO: 5650 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aatctataatttttttccta

SEQ ID NO: 5651 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
cttctgttttctttttgaaa

SEQ ID NO: 5652 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tctagtattttgtatcaatc

SEQ ID NO: 5653 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gttatcacatgcaacaagaa

SEQ ID NO: 5654 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aggatcactaaaaggagctt

SEQ ID NO: 5655 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aaaagaggcggatataagct

SEQ ID NO: 5656 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
aacaatttaaatgcttttct

SEQ ID NO: 5657 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
cccagggtgattttctgcat

SEQ ID NO: 5658 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aagaaaagtagttgtaggtt

SEQ ID NO: 5659 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ggaagtacacagtagattag

SEQ ID NO: 5660 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ctaattcctcttccccaaat

SEQ ID NO: 5661 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gtcgccaaatcagatttttt

SEQ ID NO: 5662 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tgagcttcatggtaattatt

SEQ ID NO: 5663 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gaatgcatacaacaagcatg

SEQ ID NO: 5664 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gaaaaaattaacccattgga

SEQ ID NO: 5665 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
cttttaaatcttggtttaga

SEQ ID NO: 5666 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aataagaaagaaattaaaaa

SEQ ID NO: 5667 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ggctgtcagcatcaggttag

SEQ ID NO: 5668 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ttaagttctgctgtgaactt

SEQ ID NO: 5669 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tgtatctgtgcctaggtttc

SEQ ID NO: 5670 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
acgaaattcacattttagat

SEQ ID NO: 5671 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
atatatttctattcattttt

SEQ ID NO: 5672 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
taaaactgccctcccaatgg

SEQ ID NO: 5673 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ccagaaatatgtcatgaaaa

SEQ ID NO: 5674 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aagactccagggactgtgtg

SEQ ID NO: 5675 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aatagatgtatacatgctga

SEQ ID NO: 5676 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agagtaggttaaaaaaagaa

SEQ ID NO: 5677 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tgatgaaataagatgtagaa

SEQ ID NO: 5678 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atattttattatggcaaatt

SEQ ID NO: 5679 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
accagcctggccaacatggt

SEQ ID NO: 5680 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gttaagagttcctaaattaa

SEQ ID NO: 5681 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
taccataaaccaaaagaaac

SEQ ID NO: 5682 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aattattttctaagataata

SEQ ID NO: 5683 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aatatctcacatatgcatgt

SEQ ID NO: 5684 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
aaaccacaaaactgctagaa

SEQ ID NO: 5685 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttaaaataacatacaaacca

SEQ ID NO: 5686 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
agactttatgaattttttat

SEQ ID NO: 5687 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
cactgtggtaggcactttac

SEQ ID NO: 5688 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
cataaacatgtttggcaaga

SEQ ID NO: 5689 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gagcattttcatttttttaa

SEQ ID NO: 5690 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
agataaagcaaatgtttagg

SEQ ID NO: 5691 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tttcagaagagtttgttacc

SEQ ID NO: 5692 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
tttttcttttataccagtat

SEQ ID NO: 5693 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
acattttcatcattccaaac

SEQ ID NO: 5694 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tctttctgccttacggatct

SEQ ID NO: 5695 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
tataaatgactactgcctag

SEQ ID NO: 5696 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ctttctggacatgggtaaca

SEQ ID NO: 5697 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
atgtatttaaggagaagcaa

SEQ ID NO: 5698 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gaagaatcattctagtcaca

SEQ ID NO: 5699 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gtagagacatgaagtaaatg

SEQ ID NO: 5700 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
agatatgctgtgaaaaacaa

SEQ ID NO: 5701 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gtaccataagatatgctgtg

SEQ ID NO: 5702 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aggtagactggcagataaga

SEQ ID NO: 5703 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tgaaataagtaaagggacac

SEQ ID NO: 5704 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
attcacaatagcaaaaatat

SEQ ID NO: 5705 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gatactgtactttgggatat

SEQ ID NO: 5706 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agggttttaaaacagttttg

SEQ ID NO: 5707 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
aagttgacttttaagggttt

SEQ ID NO: 5708 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
atctctactaaaaaaaatac

SEQ ID NO: 5709 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
catattttgttttaacatta

SEQ ID NO: 5710 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tcatgtaattacagctaata

SEQ ID NO: 5711 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
acatcgtaatttgttttttc

SEQ ID NO: 5712 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
ttcaaatccatgcagatgag

SEQ ID NO: 5713 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
tgcattaaaatataagtatt

SEQ ID NO: 5714 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tatctttttagttctataga

SEQ ID NO: 5715 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gctcctgcccaggtcgtggc

SEQ ID NO: 5716 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
taataatttatgactttccc

SEQ ID NO: 5717 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ttagactagcttatcaacaa

SEQ ID NO: 5718 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
acatatatataaagaaaaca

SEQ ID NO: 5719 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
tatatatacatatatataaa

SEQ ID NO: 5720 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
ataggatatcctggagaagg

SEQ ID NO: 5721 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
agctatgaaaagccatggag

SEQ ID NO: 5722 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
gaggctttacgcataattgc

SEQ ID NO: 5723 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gatgttcacccaaaggactt

SEQ ID NO: 5724 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
gacagtgtagcagtttcttt

SEQ ID NO: 5725 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: TAAAAC
caaaatatacaaataaagct

SEQ ID NO: 5726 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
attaaaaacttctgctctgc

SEQ ID NO: 5727 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
aggtgaactgcattaaaatt

SEQ ID NO: 5728 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
agggctgccaaaagagcaag

SEQ ID NO: 5729 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
ctaatcctatttaattagag

SEQ ID NO: 5730 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
actttttagctatgtataca

SEQ ID NO: 5731 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
agcatctactacatgcaaga

SEQ ID NO: 5732 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: CAAAAC
cacagaaagcacattatcag

SEQ ID NO: 5733 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: GAAAAC
gataatgttgcccaatgact

SEQ ID NO: 5734 - DNA, 20 bp, synthetic construct
  source 1..20: mol_type = other DNA; note = Description of Artificial Sequence: Synthetic oligonucleotide; note = Target: SCN9A; (-) strand; PAM type: NAAAAC; PAM sequence: AAAAAC
attgcagaatgctgtcaagc

SEQ ID NO: 5735 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctttgttaaagctatagagg

SEQ ID NO: 5736 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gaagatcctgcaaacagaaa

SEQ ID NO: 5737 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
caagaatggatttagtaaga

SEQ ID NO: 5738 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
taatgaagaggattagtttg

SEQ ID NO: 5739 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
taccttaacatggtacattg

SEQ ID NO: 5740 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgttttgtaggaaataaaat

SEQ ID NO: 5741 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
actacctaccaatgggtgca

SEQ ID NO: 5742 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
actctttttaataaagctat

SEQ ID NO: 5743 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atgttcaacaatcagcattt

SEQ ID NO: 5744 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gtcacttaaaaaagttttta

SEQ ID NO: 5745 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gaaacaaacgtaaatatata

SEQ ID NO: 5746 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttaaccatgttattttaaaa

SEQ ID NO: 5747 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ccatattttttattttacat

SEQ ID NO: 5748 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
acataaaaacaaggcaatgt

SEQ ID NO: 5749 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
taggtccctacttaaattat

SEQ ID NO: 5750 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaatgatctatgtagtctcg

SEQ ID NO: 5751 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgtaaaatatatcacaattt

SEQ ID NO: 5752 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gttgttttatatatttgctt

SEQ ID NO: 5753 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tcccacaaaaatcttctaag

SEQ ID NO: 5754 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
actattaataggtgttttca

SEQ ID NO: 5755 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
catgtgagtcaagatgaatg

SEQ ID NO: 5756 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
acatggtcttctgatttatt

SEQ ID NO: 5757 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttctgatttattaaaaacca

SEQ ID NO: 5758 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tccatctccccactctcacc

SEQ ID NO: 5759 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaaaattttcatgacattt

SEQ ID NO: 5760 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttgcattggccaacaacact

SEQ ID NO: 5761 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gtgaaaataacaacaacaac

SEQ ID NO: 5762 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
caacaaaaacaagaagatag

SEQ ID NO: 5763 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aagtattaagctgtaaaaaa

SEQ ID NO: 5764 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atgacaagtctcacatgtgc

SEQ ID NO: 5765 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tctccagtgaaaaggattat

SEQ ID NO: 5766 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaaaccacatttatccaata

SEQ ID NO: 5767 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaacaaaaaataaatgtagt

SEQ ID NO: 5768 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctttcttcacaaaattggaa

SEQ ID NO: 5769 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tactacaaggctacagtaac

SEQ ID NO: 5770 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaacagcatggtactggtac

SEQ ID NO: 5771 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgatccttgacaaacctcac

SEQ ID NO: 5772 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tatttaataaatgatgctgg

SEQ ID NO: 5773 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaagacttaaatgtaagacc

SEQ ID NO: 5774 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aatgtaagacctaaaaccat

SEQ ID NO: 5775 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atgggcaaagacttcatgac

SEQ ID NO: 5776 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaagcaatggcaacaaaagc

SEQ ID NO: 5777 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cttaaacaaatttacaagaa

SEQ ID NO: 5778 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gtcatcagagaaacacaaat

SEQ ID NO: 5779 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gtgatgattcctcaagaatc

SEQ ID NO: 5780 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agcaaaatatcacaaggacg

SEQ ID NO: 5781 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cttgacagaagaagctggag

SEQ ID NO: 5782 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agctggagaaaaactgagga

SEQ ID NO: 5783 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
caatatgatgaagaatggga

SEQ ID NO: 5784 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ttgtgcaaaatgtatccctt

SEQ ID NO: 5785 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aagtttcttaattctttaag

SEQ ID NO: 5786 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tagtatgttttatgattatt

SEQ ID NO: 5787 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgaggatgatgaatagttgg

SEQ ID NO: 5788 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
acaaaaagtcaaatatcagt

SEQ ID NO: 5789 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agaatacaataattgaacta

SEQ ID NO: 5790 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aagaatcaacaaaccaagaa

SEQ ID NO: 5791 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aagaaaaaaacaaccccatc

SEQ ID NO: 5792 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agaagacatttatgcagcca

SEQ ID NO: 5793 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gccatcagagaaatgcaaat

SEQ ID NO: 5794 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cagcaaactatcgcaaggaa

SEQ ID NO: 5795 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
cacgttgtgcacatgtaccc

SEQ ID NO: 5796 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaaaataaaaaataaaatta

SEQ ID NO: 5797 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gaccagcctggccaacatgg

SEQ ID NO: 5798 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aagtttgaaagcagcaagaa

SEQ ID NO: 5799 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tattcaaaatacttaaagaa

SEQ ID NO: 5800 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
accaagaataatatacctgg

SEQ ID NO: 5801 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctttaaaattaaggaaggat

SEQ ID NO: 5802 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aagacagaaaaaaagaatta

SEQ ID NO: 5803 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
caatggctgcatagatttat

SEQ ID NO: 5804 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gatactcgtttcagatttaa

SEQ ID NO: 5805 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
attggctgaatctacagatg

SEQ ID NO: 5806 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gccaaaatagattttaaata

SEQ ID NO: 5807 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ctggaagtcagtaatagaag

SEQ ID NO: 5808 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaagcaatagaaaaagtcaa

SEQ ID NO: 5809 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
agatagaggactcaaatatg

SEQ ID NO: 5810 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
taattcttctcaaactctct

SEQ ID NO: 5811 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agaaacccagaatccagtag

SEQ ID NO: 5812 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
cagtgccttacatttgggaa

SEQ ID NO: 5813 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ggagttttctctcaagtaca

SEQ ID NO: 5814 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tcaaagaagaaattatacgg

SEQ ID NO: 5815 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tttttgaaaagataaaatcg

SEQ ID NO: 5816 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggccagtattatactgatat

SEQ ID NO: 5817 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aagagtatgctaccagaaaa

SEQ ID NO: 5818 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
actgaattccctagcacatt

SEQ ID NO: 5819 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gcccacggctaacattatgc

SEQ ID NO: 5820 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tgacatgatctttatatgta

SEQ ID NO: 5821 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aacactctactgagaactgt

SEQ ID NO: 5822 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
attaagaaattaatcctatt

SEQ ID NO: 5823 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aagttgaagatctgtacact

SEQ ID NO: 5824 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaaactataagttgatttaa

SEQ ID NO: 5825 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tcttcaataaatggtgttgg

SEQ ID NO: 5826 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tttctcataccatatgttta

SEQ ID NO: 5827 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaactataaagctactagaa

SEQ ID NO: 5828 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaaaatagcatggaagttcc

SEQ ID NO: 5829 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ctgcaattaaaagtaatggc

SEQ ID NO: 5830 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atgcacagtgcactactata

SEQ ID NO: 5831 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaagacttaaatgtaaaatc

SEQ ID NO: 5832 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aatgtaaaatctaaaactat

SEQ ID NO: 5833 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
acaccaaaagcaactgcaac

SEQ ID NO: 5834 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
accattagagaaatgcaaat

SEQ ID NO: 5835 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tactatgcagccattcaaaa

SEQ ID NO: 5836 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agtaaactaaggcaggaaca

SEQ ID NO: 5837 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tctacaatgtttatgtagat

SEQ ID NO: 5838 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gaacaaatatttaaacagaa

SEQ ID NO: 5839 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tttcaacaacctttcatggt

SEQ ID NO: 5840 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
catggtaaaaactaaaaaaa

SEQ ID NO: 5841 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
taacatcgtattcaatggtg

SEQ ID NO: 5842 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tattcaatggtgaaaaactg

SEQ ID NO: 5843 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agccagagaaattaggcaag

SEQ ID NO: 5844 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gcattgaaaatgtatgcact

SEQ ID NO: 5845 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaaatagtatggtcctggca

SEQ ID NO: 5846 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
cactcaacaaataatgttgg

SEQ ID NO: 5847 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aacatttaaacctaagacct

SEQ ID NO: 5848 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aacctaagacctgaaaactg

SEQ ID NO: 5849 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaactgtaaaacttgtagaa

SEQ ID NO: 5850 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aatcatcagaaaattcaaat

SEQ ID NO: 5851 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgacagagtgagactccttc

SEQ ID NO: 5852 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cgaaactccgtctcaaaaaa

SEQ ID NO: 5853 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaaaaaaaaaaaaaaaaaaa

SEQ ID NO: 5854 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaaaaaaaaaaacagcaaca

SEQ ID NO: 5855 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
cctgctaggatggctattac

SEQ ID NO: 5856 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aggatggctattaccaaaac

SEQ ID NO: 5857 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gctattaccaaaacaaaaac

SEQ ID NO: 5858 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaatgatgtagctgccata

SEQ ID NO: 5859 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tatttactgtatccaaatat

SEQ ID NO: 5860 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atatctactctcaggcaggt

SEQ ID NO: 5861 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ctccaaatcttaaatttctt

SEQ ID NO: 5862 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cctctataggaaacattgga

SEQ ID NO: 5863 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
agaatagttgatatattgct

SEQ ID NO: 5864 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tccaaggtgttttaaactgt

SEQ ID NO: 5865 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tagtgtgaagcaggaagttc

SEQ ID NO: 5866 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gccaagactggcactgtttt

SEQ ID NO: 5867 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttgactaacattcataaggg

SEQ ID NO: 5868 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aataaataaaaataataaac

SEQ ID NO: 5869 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttcttatttacttaatcttt

SEQ ID NO: 5870 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgttccaagaacatttttac

SEQ ID NO: 5871 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aatgttcacttgaggctggt

SEQ ID NO: 5872 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aatggtgaacattttaatta

SEQ ID NO: 5873 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tcttagtataaatcttatta

SEQ ID NO: 5874 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tcacaagagtgggtttatta

SEQ ID NO: 5875 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
catcactttaaattttcaaa

SEQ ID NO: 5876 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tatttggggcagcctttctt

SEQ ID NO: 5877 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttaatatgttgtgtgattaa

SEQ ID NO: 5878 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
attatgtcaggcatcatatg

SEQ ID NO: 5879 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
catatggaaaacaaatctct

SEQ ID NO: 5880 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaatcacatctcctttgca

SEQ ID NO: 5881 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tctcctttgcagaaaacata

SEQ ID NO: 5882 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agcttcatgattcatttaaa

SEQ ID NO: 5883 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggaaggggcttagtcacaag

SEQ ID NO: 5884 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ttgggacattaagcaacttt

SEQ ID NO: 5885 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aacttgtcctacttttatcc

SEQ ID NO: 5886 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ggggaaaagctctcagggta

SEQ ID NO: 5887 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ataacattttcccattttaa

SEQ ID NO: 5888 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tcatagggattaattctagg

SEQ ID NO: 5889 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tacttccactcctctatggt

SEQ ID NO: 5890 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgtttcaagtattctaagtt

SEQ ID NO: 5891 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
taggttttggttaggtagat

SEQ ID NO: 5892 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tgaagaaagtttcataccca

SEQ ID NO: 5893 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gtggatgttagcagtgaatt

SEQ ID NO: 5894 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gggtgggaacctgaaacggg

SEQ ID NO: 5895 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ggtgatggaggaaatgccaa

SEQ ID NO: 5896 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atatcaagcagtcttcatgc

SEQ ID NO: 5897 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tcactaggacaggtagagga

SEQ ID NO: 5898 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tcctcataaaattttagatg

SEQ ID NO: 5899 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aagattgatctccttttctg

SEQ ID NO: 5900 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
taatcataagttgtatgttc

SEQ ID NO: 5901 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
agttgtatgttctaaaacaa

SEQ ID NO: 5902 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aacattcgataaaatgatat

SEQ ID NO: 5903 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttagaatttgtcttaaactt

SEQ ID NO: 5904 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
attcttatgattgaggaaat

SEQ ID NO: 5905 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
caaaagacagactattcatt

SEQ ID NO: 5906 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttaatttaaaaattgattat

SEQ ID NO: 5907 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ttcttaacatcaaatataac

SEQ ID NO: 5908 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttataggaagggggtgaata

SEQ ID NO: 5909 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aatctaaaagcagcacaata

SEQ ID NO: 5910 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttttaacatttatcttcagt

SEQ ID NO: 5911 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
catgtcacaccctcactata

SEQ ID NO: 5912 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
attgatgtttataggattaa

SEQ ID NO: 5913 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
agtagaaggaggtactgtta

SEQ ID NO: 5914 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atgaacttgtgactagcaag

SEQ ID NO: 5915 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tttttgcttttcaaaaaaaa

SEQ ID NO: 5916 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctcagatcaaatagttggca

SEQ ID NO: 5917 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aatacatacagcaactgtag

SEQ ID NO: 5918 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atcagtacaaaatttcactc

SEQ ID NO: 5919 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aattataactgaatattcta

SEQ ID NO: 5920 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tcaaacacagcagcactgta

SEQ ID NO: 5921 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tacaaaacacagaactcaac

SEQ ID NO: 5922 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ccagatattattgatcagtg

SEQ ID NO: 5923 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
acattctaattatgggcaac

SEQ ID NO: 5924 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tttttttaaaaaaagggcaa

SEQ ID NO: 5925 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
accaccagagaaattcagaa

SEQ ID NO: 5926 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
cactttctatccaataacat

SEQ ID NO: 5927 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gtaataagaatttatgaatt

SEQ ID NO: 5928 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gtcccataactaacagtgca

SEQ ID NO: 5929 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atgtcattcaacagagactt

SEQ ID NO: 5930 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttctttggaaacaacctgaa

SEQ ID NO: 5931 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
taataagcagaaggtaaatc

SEQ ID NO: 5932 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
agtcttgataacagtgtaat

SEQ ID NO: 5933 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atgagtgtaatttaggagag

SEQ ID NO: 5934 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ataggcattaatatagaaga

SEQ ID NO: 5935 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ctgtggatgttttaaaatat

SEQ ID NO: 5936 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tcagaaatagccaaaaataa

SEQ ID NO: 5937 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
accattacagaggtatagca

SEQ ID NO: 5938 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agatgttacgtttcgttcct

SEQ ID NO: 5939 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aagaccgagacacacaggga

SEQ ID NO: 5940 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttgaggaaatctgtcaacct

SEQ ID NO: 5941 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tctttgtgaggagaccattt

SEQ ID NO: 5942 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ataggtacttggaaccttgt

SEQ ID NO: 5943 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tatctaagatcagatcatat

SEQ ID NO: 5944 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tattttagtgatctgaatgg

SEQ ID NO: 5945 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tagtgatctgaatgggaaaa

SEQ ID NO: 5946 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atctgaatgggaaaacaaaa

SEQ ID NO: 5947 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
agtacaaataaaaaatatag

SEQ ID NO: 5948 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
actttctaacatgagctaga

SEQ ID NO: 5949 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gttatatttcacaataaaaa

SEQ ID NO: 5950 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
caattattaagaactagtaa

SEQ ID NO: 5951 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgttgtgtaaagtcacgcac

SEQ ID NO: 5952 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gtgtttgtccacgctgcttc

SEQ ID NO: 5953 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agttctcttttatgaaccca

SEQ ID NO: 5954 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
cctgtgagaaacaggtagaa

SEQ ID NO: 5955 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tccctcattttggtcatacc

SEQ ID NO: 5956 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tgatatagacccgagctgac

SEQ ID NO: 5957 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atctatattgcctttcaaag

SEQ ID NO: 5958 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
attgttcaaaggcccacttc

SEQ ID NO: 5959 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgtgccctaataagcatctt

SEQ ID NO: 5960 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
accagcctggccaacatgac

SEQ ID NO: 5961 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gctataggagcttataaata

SEQ ID NO: 5962 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaggaatttgtaaggctata

SEQ ID NO: 5963 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaaaaaaagtacaagccaa

SEQ ID NO: 5964 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atgctataggccagtggctg

SEQ ID NO: 5965 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aatatgggttatttggctag

SEQ ID NO: 5966 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaaagtttttaaaaataatg

SEQ ID NO: 5967 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atgtttttctgttaatatta

SEQ ID NO: 5968 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atattaaaatttcagaagag

SEQ ID NO: 5969 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gttctggaagaagataaaaa

SEQ ID NO: 5970 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aactcagcgagcacatgggg

SEQ ID NO: 5971 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cctgcctcacatccatagtc

SEQ ID NO: 5972 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atagccataaataatgtgtt

SEQ ID NO: 5973 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atgagactattctgtccaga

SEQ ID NO: 5974 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tgctgtaatagttcacaggt

SEQ ID NO: 5975 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttatccatttttaagcacat

SEQ ID NO: 5976 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tggttatctttaccatcatt

SEQ ID NO: 5977 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gtcatgtgacagtcctacat

SEQ ID NO: 5978 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tctagaaattgttgccatgc

SEQ ID NO: 5979 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gtgagaaaatgtcttatttt

SEQ ID NO: 5980 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
cttggaaactaattcaaatt

SEQ ID NO: 5981 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
agtcatgcatgtatgtgtat

SEQ ID NO: 5982 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tcaactttttgaaaagtctc

SEQ ID NO: 5983 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tactgatttttctatggtga

SEQ ID NO: 5984 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
acatattacacacataattg

SEQ ID NO: 5985 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atgaaatattttttaaaaat

SEQ ID NO: 5986 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tgcctcaattttcccatttg

SEQ ID NO: 5987 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ccagccatgcctgagctatg

SEQ ID NO: 5988 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttctgctgcttcgccttgca

SEQ ID NO: 5989 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gtgactgcagaaaaattaaa

SEQ ID NO: 5990 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gacttaaaagaaacatactt

SEQ ID NO: 5991 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
acgaagcaattcagtgagaa

SEQ ID NO: 5992 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gtatggtaaggtctttgcct

SEQ ID NO: 5993 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atttgtggggttgtgtgatg

SEQ ID NO: 5994 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gaaaacagggaagacctaag

SEQ ID NO: 5995 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttttaaccaatgaagcatta

SEQ ID NO: 5996 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tacaaggtaattttggaatg

SEQ ID NO: 5997 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaacactaaaaaattcttgt

SEQ ID NO: 5998 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gggaaataaagatataaatg

SEQ ID NO: 5999 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tcatgataaaataattttaa

SEQ ID NO: 6000 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaaaatccttgtgacattaa

SEQ ID NO: 6001 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctcatgatataataatttaa

SEQ ID NO: 6002 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agaaaagttatatcttcatg

SEQ ID NO: 6003 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
acataaacagaaccaatgac

SEQ ID NO: 6004 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atgcaacatccattcatgtt

SEQ ID NO: 6005 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaataataagagctatttat

SEQ ID NO: 6006 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aagctggaagcattcccttt

SEQ ID NO: 6007 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atgacatgattctatattta

SEQ ID NO: 6008 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaacccgatcatctcagccc

SEQ ID NO: 6009 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gagaggacacaaacaaatgg

SEQ ID NO: 6010 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttgacatcttcacagaatta

SEQ ID NO: 6011 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tactatgaggttacagtaac

SEQ ID NO: 6012 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgatcttcgacaaacctgac

SEQ ID NO: 6013 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aagctggctagccatatgca

SEQ ID NO: 6014 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gatggattaaagacttaatg

SEQ ID NO: 6015 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aatgtaaaaccccaaaccat

SEQ ID NO: 6016 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaccatgaaaaccctagaa

SEQ ID NO: 6017 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaataggccaaaaaagaaaa

SEQ ID NO: 6018 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gagcaattgatttgggagag

SEQ ID NO: 6019 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tttaaataggagttcaaaaa

SEQ ID NO: 6020 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggccatcccaagcacgcatg

SEQ ID NO: 6021 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
catgtgcaggagcagcttga

SEQ ID NO: 6022 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
catattattagtgatgggag

SEQ ID NO: 6023 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cctccattctcaaataaata

SEQ ID NO: 6024 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gccattagcatcatcatcat

SEQ ID NO: 6025 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atccctttgcttagagtggc

SEQ ID NO: 6026 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttcagcctttagactaaaaa

SEQ ID NO: 6027 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atatatggtccgctattgac

SEQ ID NO: 6028 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agtaaatgtttaaatgacta

SEQ ID NO: 6029 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
acattctgtactagctgctc

SEQ ID NO: 6030 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aactattatacaatttgaga

SEQ ID NO: 6031 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tcttacttagaagacacaga

SEQ ID NO: 6032 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tgtgcatgaaaagctttcct

SEQ ID NO: 6033 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tagctcactctaggtttgta

SEQ ID NO: 6034 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aattgaaaatgtatttccac

SEQ ID NO: 6035 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ctataccatggataaatttt

SEQ ID NO: 6036 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggcaaataatgcaactctga

SEQ ID NO: 6037 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggcaaatgtagttctcacaa

SEQ ID NO: 6038 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ggccaatattgcggtttttt

SEQ ID NO: 6039 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tattaaatgtcaaatattag

SEQ ID NO: 6040 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atcttatactttgaggaaat

SEQ ID NO: 6041 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tactcattcattatcactag

SEQ ID NO: 6042 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cactagcaaaacatccatac

SEQ ID NO: 6043 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tgatttaaacacctcttcac

SEQ ID NO: 6044 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tttcttttaacaaaggttaa

SEQ ID NO: 6045 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaaggacagatcccagtga

SEQ ID NO: 6046 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atatgctaaacattttactt

SEQ ID NO: 6047 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctatattgaaggaagccatt

SEQ ID NO: 6048 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
attattttcaagtgaatttc

SEQ ID NO: 6049 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaagcctctgaatcgaaaca

SEQ ID NO: 6050 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
cacttctctataaatggcac

SEQ ID NO: 6051 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tggtttgctgagaaaaaata

SEQ ID NO: 6052 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cttcctgtataagcaaatgg

SEQ ID NO: 6053 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gacttttgataatgattgtg

SEQ ID NO: 6054 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tttagacttttaatttttta

SEQ ID NO: 6055 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aatagacaaatccatagaga

SEQ ID NO: 6056 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gcaagtttgtcaatatactg

SEQ ID NO: 6057 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaagctgaaagtacttacgc

SEQ ID NO: 6058 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaaatacacccatataatta

SEQ ID NO: 6059 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ctgacaagttcattctttga

SEQ ID NO: 6060 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaaggatgaaatgataatac

SEQ ID NO: 6061 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
taatactgaaattaataaac

SEQ ID NO: 6062 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tatctctaatatttttatca

SEQ ID NO: 6063 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttactaaccacggtaattta

SEQ ID NO: 6064 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttagtattcagttaagaaat

SEQ ID NO: 6065 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atgcggcagcgttccctcaa

SEQ ID NO: 6066 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cccgtctctactaaaaatac

SEQ ID NO: 6067 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tagcaattttcattctcatt

SEQ ID NO: 6068 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
actttcttcacagaactgga

SEQ ID NO: 6069 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aaacagcatggtactggtac

SEQ ID NO: 6070 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgatctttgacaaacctgag

SEQ ID NO: 6071 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tatttaacaaatggtgctgg

SEQ ID NO: 6072 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaagacttaaacattagacc

SEQ ID NO: 6073 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aacattagacctaaaaccat

SEQ ID NO: 6074 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaccataaaaaccctagaa

SEQ ID NO: 6075 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atgggcaaggacttcatgtc

SEQ ID NO: 6076 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctcaaacaaatttacaagaa

SEQ ID NO: 6077 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agaagacatttatgcagcca

SEQ ID NO: 6078 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gccatcagagaaatgcaaat

SEQ ID NO: 6079 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agtaaactatcacaagaata

SEQ ID NO: 6080 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
cacaatgtgcacatgtaccc

SEQ ID NO: 6081 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cctgccaagaaaggcccatt

SEQ ID NO: 6082 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tgatcttctatctagatcac

SEQ ID NO: 6083 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ggatgtggttcatagcaccc

SEQ ID NO: 6084 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ggtacagactcaagggaatt

SEQ ID NO: 6085 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctgaattagtatttagcaat

SEQ ID NO: 6086 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tgttacaacatggatgtgat

SEQ ID NO: 6087 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ttggggtgataaaaatattc

SEQ ID NO: 6088 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
catacctttgtgaacatact

SEQ ID NO: 6089 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gtgtgtaaattatatcttaa

SEQ ID NO: 6090 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atatctcataaaatttagta

SEQ ID NO: 6091 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cttcaaatttccattgcagt

SEQ ID NO: 6092 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaatgttagataatatcact

SEQ ID NO: 6093 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
caaatatgtgatgtagatca

SEQ ID NO: 6094 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atttattcaataatgttgca

SEQ ID NO: 6095 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaaaaaaaaaataggctacc

SEQ ID NO: 6096 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaaattaaaaaagtacaaaa

SEQ ID NO: 6097 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
caaaaaaaaaaaagtacttc

SEQ ID NO: 6098 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ccatagaattacttagaaat

SEQ ID NO: 6099 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
attttcaaattagaaagtta

SEQ ID NO: 6100 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gataaaaaggaaaatatcag

SEQ ID NO: 6101 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agaagagttggaatgagggg

SEQ ID NO: 6102 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gtctttcctagcatttattt

SEQ ID NO: 6103 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
actttatgaaacactactta

SEQ ID NO: 6104 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggctctgaacatactatttg

SEQ ID NO: 6105 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tttcatccccaaggtactat

SEQ ID NO: 6106 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
acatatgtgatcttccttcc

SEQ ID NO: 6107 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ctcaaagtatcaacatcatc

SEQ ID NO: 6108 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agagaaaaaggaaattagtg

SEQ ID NO: 6109 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tcttataggccttctcccat

SEQ ID NO: 6110 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaaatttccagatggatct

SEQ ID NO: 6111 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aggtctgtgaaaccccttga

SEQ ID NO: 6112 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tcccctagtctagattcagt

SEQ ID NO: 6113 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tctatacacttaagtagagt

SEQ ID NO: 6114 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gatgaacgtaaaatgttttt

SEQ ID NO: 6115 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttttaaaaacttctttttct

SEQ ID NO: 6116 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ggtttatgttttatggtttt

SEQ ID NO: 6117 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ccttaccattatttgtatat

SEQ ID NO: 6118 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aattttttctctgttgtgta

SEQ ID NO: 6119 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttccttacttttcaaattac

SEQ ID NO: 6120 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agggcttacagtctgttggg

SEQ ID NO: 6121 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tacttttgcttctggtatga

SEQ ID NO: 6122 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tgtgggaactaggttatgac

SEQ ID NO: 6123 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tttctgcaatatccacagtc

SEQ ID NO: 6124 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aatcacagatgtaaatataa

SEQ ID NO: 6125 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atgatgctaacttactacaa

SEQ ID NO: 6126 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttaaaaatattttccactga

SEQ ID NO: 6127 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ctaagttgtgttgttcctct

SEQ ID NO: 6128 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atggctatgccataaaaaag

SEQ ID NO: 6129 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
caaattaagtcatgtgagct

SEQ ID NO: 6130 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
attgttcataaaatttatca

SEQ ID NO: 6131 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
atgatcaagtccatattttg

SEQ ID NO: 6132 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aagatcggttaccaagtgaa

SEQ ID NO: 6133 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gtacataaatgatcatagta

SEQ ID NO: 6134 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gatcatagtacaaaacatgg

SEQ ID NO: 6135 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tgtctaacgcccatgtgtac

SEQ ID NO: 6136 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
acattagaggaaggatgttt

SEQ ID NO: 6137 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaactgtccttgtaattaaa

SEQ ID NO: 6138 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gcatctatatttaaattaac

SEQ ID NO: 6139 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
actctacagtattacagctt

SEQ ID NO: 6140 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gcttgaaaacaaagaaaaga

SEQ ID NO: 6141 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atttgacatgggttttcttt

SEQ ID NO: 6142 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tagtgtttccacattgattg

SEQ ID NO: 6143 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
acctttttagaagaaaagtt

SEQ ID NO: 6144 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ggctatttaaagtttgtaca

SEQ ID NO: 6145 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aacaatctacacatgcagtg

SEQ ID NO: 6146 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
catccctaccttcatgctgc

SEQ ID NO: 6147 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
acatagagtgcattgagttt

SEQ ID NO: 6148 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tcaatgttttatttcaaaaa

SEQ ID NO: 6149 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gaagtaaaggcttcacatat

SEQ ID NO: 6150 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tttgtgcaaacagggaaaga

SEQ ID NO: 6151 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atagctgtatgattagatga

SEQ ID NO: 6152 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agcttatatccgcctctttt

SEQ ID NO: 6153 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaggggtttattgattgata

SEQ ID NO: 6154 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gatataaaactaagttccag

SEQ ID NO: 6155 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
catttcaaattaatagagga

SEQ ID NO: 6156 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaacaaacaaacatacaaac

SEQ ID NO: 6157 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tacactttccaatattactg

SEQ ID NO: 6158 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tgaaaagagtaaacaagcaa

SEQ ID NO: 6159 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaagtaagattttaatattt

SEQ ID NO: 6160 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttcagctgctaccctgacaa

SEQ ID NO: 6161 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
agaaagacacaaaaatacag

SEQ ID NO: 6162 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aatcaataaatgatgacacg

SEQ ID NO: 6163 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aggaggataaatatttaaaa

SEQ ID NO: 6164 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttcaggatgggcaacaagag

SEQ ID NO: 6165 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
caacaagagcaaaactccgt

SEQ ID NO: 6166 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aacaaacaaacaaacaaaca

SEQ ID NO: 6167 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aattaggtcacaatattcct

SEQ ID NO: 6168 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
gtctgcaatatttctcattt

SEQ ID NO: 6169 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttaaagtatctctgggcacc

SEQ ID NO: 6170 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gtaaggagagagattatcag

SEQ ID NO: 6171 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ctatatgtgcctcagaaaca

SEQ ID NO: 6172 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gactttttttataatatttt

SEQ ID NO: 6173 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gcctaaaaagaagaataata

SEQ ID NO: 6174 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaagaagaataatacaaaac

SEQ ID NO: 6175 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggatgatatgtgtcaaaggt

SEQ ID NO: 6176 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaacccgtaaaatggggaga

SEQ ID NO: 6177 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
taaataacaagttaaaaaga

SEQ ID NO: 6178 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aggaaagcaagcttcaatca

SEQ ID NO: 6179 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
agaactatgagcattcaact

SEQ ID NO: 6180 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ttttttaatttctttcttat

SEQ ID NO: 6181 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tgtgctacaaaaaaatgcct

SEQ ID NO: 6182 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tttctcctcattaaaaaaat

SEQ ID NO: 6183 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttaaaaaaattaaaacattg

SEQ ID NO: 6184 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gtgacatcgaaatacaattt

SEQ ID NO: 6185 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tttcattgggagaaaattta

SEQ ID NO: 6186 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ttaagtatagtcatttaaaa

SEQ ID NO: 6187 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aaacttcataatttgatatt

SEQ ID NO: 6188 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tcttttaactttgtctttac

SEQ ID NO: 6189 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tacacacataatggtttgca

SEQ ID NO: 6190 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ttgaagaataaatttagcca

SEQ ID NO: 6191 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tgagcctaataagtggggaa

SEQ ID NO: 6192 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
atgagccaccacacccggcc

SEQ ID NO: 6193 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tctcaggtgaaaagaaaaaa

SEQ ID NO: 6194 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ggtgaaaagaaaaaagaaaa

SEQ ID NO: 6195 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atacctcttctttagattat

SEQ ID NO: 6196 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gccaagtataatatcacaag

SEQ ID NO: 6197 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gtagttgaacaactggtatg

SEQ ID NO: 6198 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
taagaagtgtattaccctgg

SEQ ID NO: 6199 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atacatgtatccacttccct

SEQ ID NO: 6200 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
catgagttggccaataaaca

SEQ ID NO: 6201 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
aagcttttgtattgcatata

SEQ ID NO: 6202 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
actaaaatgtatgcttatag

SEQ ID NO: 6203 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atgttgaaagatttaataac

SEQ ID NO: 6204 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ggaacatttgtggacattgt

SEQ ID NO: 6205 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gataaagcaagtgcataggc

SEQ ID NO: 6206 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aacctccacaaggattgtct

SEQ ID NO: 6207 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tgtggtataaacactaacct

SEQ ID NO: 6208 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
tttcggtaacaaactcttct

SEQ ID NO: 6209 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
ctcttctgaaaacactttaa

SEQ ID NO: 6210 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ttgatctacttgaccgttga

SEQ ID NO: 6211 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tttaatactggtataaaaga

SEQ ID NO: 6212 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gtataaaagaaaaaacagaa

SEQ ID NO: 6213 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gagtaaggcacattcagact

SEQ ID NO: 6214 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atcatttgggaaatgcaaat

SEQ ID NO: 6215 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aaaatagtgcagctgctgtg

SEQ ID NO: 6216 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
aatcacagtagccaaaaagt

SEQ ID NO: 6217 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
acgacccggatgaacacctt

SEQ ID NO: 6218 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tctaaatcacaaaaaaagac

SEQ ID NO: 6219 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gtaatccctacaaaatcaag

SEQ ID NO: 6220 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
gctatatctgatgtctacaa

SEQ ID NO: 6221 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ttatctcattgcagtgctga

SEQ ID NO: 6222 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tgtaaaataaattagttttc

SEQ ID NO: 6223 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ttagttttccaaaactgttt

SEQ ID NO: 6224 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
ccatttcagttttttaatgt

SEQ ID NO: 6225 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
aagtgaagtcattcaaccta

SEQ ID NO: 6226 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tcaacctataaaacaacttc

SEQ ID NO: 6227 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
tggtgaaaccccatctctac

SEQ ID NO: 6228 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ggcacacctttacctatgta

SEQ ID NO: 6229 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
actaaagtggctgttttgga

SEQ ID NO: 6230 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaaataattacattggattt

SEQ ID NO: 6231 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tccgtctctactaaaaatac

SEQ ID NO: 6232 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tttcaaccaaatgttaatag

SEQ ID NO: 6233 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
atgatcaaaaatgatctttc

SEQ ID NO: 6234 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aaatgatctttccaaaacaa

SEQ ID NO: 6235 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
tcagcacagcaacaggtagt

SEQ ID NO: 6236 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
atcatatatccagtcactgt

SEQ ID NO: 6237 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
taaacctctacaaaatttta

SEQ ID NO: 6238 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
cttactgacactagcttctt

SEQ ID NO: 6239 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
aacgctccaacttaaaaaaa

SEQ ID NO: 6240 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
gaaatgtttactataatcac

SEQ ID NO: 6241 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tggcagcaaacccacagagt

SEQ ID NO: 6242 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ggcttggtggggagctggag

SEQ ID NO: 6243 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
gagcaattttaggttcacag

SEQ ID NO: 6244 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: TAAAAC
cataaaatcctggaaaatga

SEQ ID NO: 6245 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
acaattgccactgcaatttt

SEQ ID NO: 6246 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: AAAAAC
ggcaatattacaaagtaaga

SEQ ID NO: 6247 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
ggtctggatttttttggcca

SEQ ID NO: 6248 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
tctgtggagttatttttgat

SEQ ID NO: 6249 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: GAAAAC
acagcattctgcaattgtgt

SEQ ID NO: 6250 - DNA, 20 bp, synthetic construct
  source 1..20: mol_type = other DNA; note = Description of Artificial Sequence: Synthetic oligonucleotide; note = Target: SCN9A; (+) strand; PAM type: NAAAAC; PAM sequence: CAAAAC
cagtcaaagtgaaaagacct

SEQ ID NO: 6251 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
tcctctatagctttaacaaa

SEQ ID NO: 6252 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gctcacaaaataaaattagt

SEQ ID NO: 6253 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tggattcaaccaattctgga

SEQ ID NO: 6254 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tagactgggtggctagaaca

SEQ ID NO: 6255 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ttatcatttttgtgttggtc

SEQ ID NO: 6256 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
tgcctttaaaatgtaggcca

SEQ ID NO: 6257 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
agtaattttctcaaagtcaa

SEQ ID NO: 6258 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
caaatttttacccagaagcc

SEQ ID NO: 6259 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ctcgcccgcaaaagactgat

SEQ ID NO: 6260 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
aatacagatgagcaacgcta

SEQ ID NO: 6261 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ttccaatgtaccatgttaag

SEQ ID NO: 6262 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
cactaattccttctaacaga

SEQ ID NO: 6263 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
agaatgatatcttgctcata

SEQ ID NO: 6264 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
actgctcatttttatatgag

SEQ ID NO: 6265 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gagaactgctcatttttata

SEQ ID NO: 6266 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
aaattatatccagtgaatat

SEQ ID NO: 6267 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tttttagtgatgtgtaaaat

SEQ ID NO: 6268 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aagcaatgcacaataagtat

SEQ ID NO: 6269 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
gaatctttttaaatatatct

SEQ ID NO: 6270 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
ggtaatctctctcaagggag

SEQ ID NO: 6271 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
tgcaatagccactctgcaaa

SEQ ID NO: 6272 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tagaatgagacaagcttcat

SEQ ID NO: 6273 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
ttcattatgtggttgtaatg

SEQ ID NO: 6274 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
acatcaaggtttgtgcaaag

SEQ ID NO: 6275 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
cgggaaacaaagacaaggac

SEQ ID NO: 6276 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
acacgtattttctgtttcag

SEQ ID NO: 6277 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tgacacattgtaatataatc

SEQ ID NO: 6278 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
atcttcttgaggaaaacaat

SEQ ID NO: 6279 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
cagttctaaatagctatttc

SEQ ID NO: 6280 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
gttacactgaagaacttaac

SEQ ID NO: 6281 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aacttattacacccaacaat

SEQ ID NO: 6282 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tcaattaaaaataatatttg

SEQ ID NO: 6283 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gatttttaaatacattcaat

SEQ ID NO: 6284 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
taaagaatgagatcagaagt

SEQ ID NO: 6285 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
agaaacaaagatttatggtt

SEQ ID NO: 6286 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
aagaggatttaaacgtacct

SEQ ID NO: 6287 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ttgttgttctggcaatttaa

SEQ ID NO: 6288 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
gcaaaaattgagctacacag

SEQ ID NO: 6289 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
acctattaatagtaatttga

SEQ ID NO: 6290 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tcaaaaaaaacaaagataac

SEQ ID NO: 6291 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
tttcatatccctttttgttc

SEQ ID NO: 6292 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
taaataaacaacacacgcat

SEQ ID NO: 6293 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ttaataaatcagaagaccat

SEQ ID NO: 6294 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tttttgcactgatgattctt

SEQ ID NO: 6295 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
agtcactaactctgatttcc

SEQ ID NO: 6296 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
agaaatatgaacaagacaga

SEQ ID NO: 6297 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
agtgtaacaaagccagacaa

SEQ ID NO: 6298 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
atgttaatgagaactcaagt

SEQ ID NO: 6299 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
attctcttcgttcacagatg

SEQ ID NO: 6300 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
agaattttagtgttgccact

SEQ ID NO: 6301 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
atgtacattgcagtcatact

SEQ ID NO: 6302 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aaaaaactgtcttgaattca

SEQ ID NO: 6303 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctactcgggaggctgaggca

SEQ ID NO: 6304 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
gcccatgaacttagtaaaaa

SEQ ID NO: 6305 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gtgtgtgtacatgtgcttgc

SEQ ID NO: 6306 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctactctggaggctgaggct

SEQ ID NO: 6307 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
agcactatcatatactgcca

SEQ ID NO: 6308 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
ttttggtaaaaaactataaa

SEQ ID NO: 6309 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
aaattgttcttataaattaa

SEQ ID NO: 6310 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
agaaaggatcaatactttaa

SEQ ID NO: 6311 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CGAGAAA
gtttacataacagttaaggc

SEQ ID NO: 6312 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aagccaaaaaaaaaaatgaa

SEQ ID NO: 6313 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aatgattctaaattcatctg

SEQ ID NO: 6314 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gaagaaaactttaggatata

SEQ ID NO: 6315 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ctttatcatatgagacttct

SEQ ID NO: 6316 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tatcttatacatgaaaaaaa

SEQ ID NO: 6317 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gaacttgttcatatattgaa

SEQ ID NO: 6318 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tgttggccaatgcaattaga

SEQ ID NO: 6319 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
aaaatgtattaaaatttagg

SEQ ID NO: 6320 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aagtcataccaaaattgata

SEQ ID NO: 6321 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aaggttcaaggttgcatgac

SEQ ID NO: 6322 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
ttttaggattgtatttcttt

SEQ ID NO: 6323 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
ttaaagtgaagttaagatct

SEQ ID NO: 6324 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
gtgaatttgtgaaaattctt

SEQ ID NO: 6325 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
attaatgataatattaatag

SEQ ID NO: 6326 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
ttgagtaagtcagtacaatg

SEQ ID NO: 6327 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gtgattatctccattgtagg

SEQ ID NO: 6328 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
tttttataatccttttcact

SEQ ID NO: 6329 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
tcaacatggtaaccatgatg

SEQ ID NO: 6330 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
atctttatgacagaagaaca

SEQ ID NO: 6331 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
ttaacctattttagtaatct

SEQ ID NO: 6332 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
caacactgattagcacacca

SEQ ID NO: 6333 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tagtttttttccaattttgt

SEQ ID NO: 6334 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
ccgtccttgtgatattttgc

SEQ ID NO: 6335 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gagtttcttgaaatagagat

SEQ ID NO: 6336 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tttatgttgaaatcctttat

SEQ ID NO: 6337 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
attgataacttcctcagtac

SEQ ID NO: 6338 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tgtaaaacttacagctaact

SEQ ID NO: 6339 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
aggtgaaattatagactaat

SEQ ID NO: 6340 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gctgaatattaccaaatcca

SEQ ID NO: 6341 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
accattaggtgtttgatgaa

SEQ ID NO: 6342 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
aacaacaaaaacactctaag

SEQ ID NO: 6343 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
ctacttgggaggctgagaca

SEQ ID NO: 6344 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
gaaaaaaactagcctgactt

SEQ ID NO: 6345 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gcctcaatgtagattgtaac

SEQ ID NO: 6346 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aagaaacttacccaaggaca

SEQ ID NO: 6347 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ggtggttttacttaaagaat

SEQ ID NO: 6348 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
atgatgaggtggttttactt

SEQ ID NO: 6349 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
gaaaatgaataaattagccc

SEQ ID NO: 6350 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
gcattggtgtctgtgcattg

SEQ ID NO: 6351 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
ttttccttgcgatagtttgc

SEQ ID NO: 6352 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gttcaattcccacctatgag

SEQ ID NO: 6353 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tgctcttttaaagtttccac

SEQ ID NO: 6354 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tccctcagcatttgcttgta

SEQ ID NO: 6355 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tttgacatttaacttttata

SEQ ID NO: 6356 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
acctgatatgtgatctatcc

SEQ ID NO: 6357 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
aaagttttaagagagtttga

SEQ ID NO: 6358 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
gtctttgtctggctttgata

SEQ ID NO: 6359 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gtttacttggtacgtccatg

SEQ ID NO: 6360 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
cactctagaaaaagcatttt

SEQ ID NO: 6361 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
atctcttctctctttacact

SEQ ID NO: 6362 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
cccatcgttttttgtacttg

SEQ ID NO: 6363 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tcaaaaaaaaaaaaaaaaaa

SEQ ID NO: 6364 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctactcgggaggctgaggca

SEQ ID NO: 6365 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gagaccttccacatctttta

SEQ ID NO: 6366 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tagttcaagccttcctctaa

SEQ ID NO: 6367 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
gagtgtttcatgtgatttga

SEQ ID NO: 6368 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ctagtttcatgtcatcatga

SEQ ID NO: 6369 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
aattcatattacttctttaa

SEQ ID NO: 6370 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
aattttttggaagaatttga

SEQ ID NO: 6371 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
acctccttttcaattttttg

SEQ ID NO: 6372 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
atttttggatctatgttcat

SEQ ID NO: 6373 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ttgtcttgttcctgatctta

SEQ ID NO: 6374 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
ggatacctcattgttaatgt

SEQ ID NO: 6375 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tatttctgtgaaaactgaca

SEQ ID NO: 6376 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
ggttttataaacatatggta

SEQ ID NO: 6377 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
tgtgcttttagagtcctagc

SEQ ID NO: 6378 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gccattcatatctcttcttt

SEQ ID NO: 6379 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tgtgtgcatgtgtctttata

SEQ ID NO: 6380 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
cacttatcatttttttgtgg

SEQ ID NO: 6381 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ttttgatctacataaacatt

SEQ ID NO: 6382 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tggcacaaagagagaataag

SEQ ID NO: 6383 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
atgatacacatggcacaaag

SEQ ID NO: 6384 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
catccatttgtgctactata

SEQ ID NO: 6385 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
agattgtttattgttagtgt

SEQ ID NO: 6386 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
ataaataaataaataagaaa

SEQ ID NO: 6387 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tctctcaataaataaataaa

SEQ ID NO: 6388 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tttttgtgtatggtataata

SEQ ID NO: 6389 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ttgaattttggagtcattgc

SEQ ID NO: 6390 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gtgatgaactcatttattcc

SEQ ID NO: 6391 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tctgaccttttctgaatgat

SEQ ID NO: 6392 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
ataggataaattaagcgtgt

SEQ ID NO: 6393 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
ctaaatggtagaattacaaa

SEQ ID NO: 6394 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
agatctttggagactaaatg

SEQ ID NO: 6395 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
ccattaaaacattttagagg

SEQ ID NO: 6396 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
aattagtcctgtgtgtcaat

SEQ ID NO: 6397 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
gtttcattatggatctagct

SEQ ID NO: 6398 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tagtatcctcatttaacctc

SEQ ID NO: 6399 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
attcatatatgttgagtagg

SEQ ID NO: 6400 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
tttgaagaaatttaagattt

SEQ ID NO: 6401 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
atagcaatgctttcggtttt

SEQ ID NO: 6402 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gctaacccacatggagtgaa

SEQ ID NO: 6403 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
catgtagcaacggagaggca

SEQ ID NO: 6404 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
gagtaaaaatagatgctgct

SEQ ID NO: 6405 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tataatcatgataaatacaa

SEQ ID NO: 6406 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
catgttctctttaaagcctc

SEQ ID NO: 6407 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aaacctgagggcttaaaaca

SEQ ID NO: 6408 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
ctcaaggagtttatgtcata

SEQ ID NO: 6409 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
cctatagaggattgaataat

SEQ ID NO: 6410 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ttaatcttattcatttttgc

SEQ ID NO: 6411 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
atcatagataatttcaacca

SEQ ID NO: 6412 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
acctggtcaaaccatgtgaa

SEQ ID NO: 6413 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
taaagatgtattcggaatca

SEQ ID NO: 6414 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
atgtgaaataagttccatgc

SEQ ID NO: 6415 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
atagtgttgtgaggacccaa

SEQ ID NO: 6416 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aaactctgtttatggctatt

SEQ ID NO: 6417 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
taattaactgggactaagat

SEQ ID NO: 6418 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tcacaggcaactgtaacaat

SEQ ID NO: 6419 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
tggagaaccctttaaaaaat

SEQ ID NO: 6420 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctgcttgggaggctgaggca

SEQ ID NO: 6421 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ctcaaaaaaagagaataaga

SEQ ID NO: 6422 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aatgtctcaaaaaaagagaa

SEQ ID NO: 6423 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gtggagaatgtctcaaaaaa

SEQ ID NO: 6424 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
aagattctcaatccttttgt

SEQ ID NO: 6425 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gcagaaataaagaaaggatt

SEQ ID NO: 6426 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaatgctgaaaagcagaaat

SEQ ID NO: 6427 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
agcagtacaaatgctgaaaa

SEQ ID NO: 6428 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
gttttgaaagattaagtaaa

SEQ ID NO: 6429 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
gagaacctgcttaatacatt

SEQ ID NO: 6430 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
ctgtaagaatctgatgaaag

SEQ ID NO: 6431 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ttttgaggtcacatagactg

SEQ ID NO: 6432 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
ataccacatggtagggaggc

SEQ ID NO: 6433 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tccatcattactcacatttt

SEQ ID NO: 6434 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ttacaggtgaattggatgca

SEQ ID NO: 6435 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
acttaattttttgagcatta

SEQ ID NO: 6436 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
ttttgtgcagaaaggtggta

SEQ ID NO: 6437 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
aattacaagtttcattttgt

SEQ ID NO: 6438 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tataacggtttccaagtata

SEQ ID NO: 6439 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
cagaaactccaggatgggga

SEQ ID NO: 6440 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ctcaccccagacctactgag

SEQ ID NO: 6441 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
ctactagggaggctgaggca

SEQ ID NO: 6442 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
aattataactaaattatatt

SEQ ID NO: 6443 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
aactacctgggtaaggagca

SEQ ID NO: 6444 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
gtgttcaaataatatttgtt

SEQ ID NO: 6445 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
ttatctaatattgtcaaaca

SEQ ID NO: 6446 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
actattatatattaatatat

SEQ ID NO: 6447 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
aatataaaaacaatgggtat

SEQ ID NO: 6448 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tagatttgaaggaatgaggg

SEQ ID NO: 6449 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
tgagttgcttttagtgagtt

SEQ ID NO: 6450 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tcttttaaatctatttcctt

SEQ ID NO: 6451 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
tatgcatgatttctattcaa

SEQ ID NO: 6452 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
cacacttttagggcttagct

SEQ ID NO: 6453 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
tagggcagaagcaatcttgt

SEQ ID NO: 6454 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tagatctttggtgctaatct

SEQ ID NO: 6455 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gactggttaaagtattcaat

SEQ ID NO: 6456 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gtatatatacgtgtgtgttt

SEQ ID NO: 6457 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
acttatattatttgctactc

SEQ ID NO: 6458 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
caaccccaagacatactgaa

SEQ ID NO: 6459 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tttttttttttctgaaaagt

SEQ ID NO: 6460 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
tgttcaggggtatgtaatgt

SEQ ID NO: 6461 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ctcattttcatcattcagtg

SEQ ID NO: 6462 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
agaaaggctgccccaaataa

SEQ ID NO: 6463 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ttttgtaatatagtagtttt

SEQ ID NO: 6464 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
gttatcttaggtttcctcta

SEQ ID NO: 6465 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
ctactcaggaggctgaggca

SEQ ID NO: 6466 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
catacagcatcatatgtgga

SEQ ID NO: 6467 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ggtttgcattatcgagcttt

SEQ ID NO: 6468 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
acctaacctttgtgtttagg

SEQ ID NO: 6469 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ttactaattcttctagattt

SEQ ID NO: 6470 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
atctcccagtcttatttttc

SEQ ID NO: 6471 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gtgagatcaaggactctcaa

SEQ ID NO: 6472 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aggcttctgattgagataga

SEQ ID NO: 6473 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ttacatattattttaacgaa

SEQ ID NO: 6474 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
atgcgacttgcccttcatct

SEQ ID NO: 6475 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gatttgaatgtcattcttgt

SEQ ID NO: 6476 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tatctgtgaggaatattaga

SEQ ID NO: 6477 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
caggctataggtttattctt

SEQ ID NO: 6478 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
atgtttcagcagtcttagca

SEQ ID NO: 6479 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
tgttatatgataactgtaaa

SEQ ID NO: 6480 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
aggacttatccaattttaat

SEQ ID NO: 6481 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
aggaagcaccgcattaatgg

SEQ ID NO: 6482 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
taatagtgtttcgatctgaa

SEQ ID NO: 6483 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
gaaagcagaacgtagaataa

SEQ ID NO: 6484 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
tagagtattgaaagcagaac

SEQ ID NO: 6485 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
agatggcttgcctgattcct

SEQ ID NO: 6486 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
tctgaccctgtacaccagtt

SEQ ID NO: 6487 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gaaagaagagtatacacaaa

SEQ ID NO: 6488 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tttcactgtgttgtggctcc

SEQ ID NO: 6489 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
tagcttatacttattgtgtt

SEQ ID NO: 6490 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ttttaaataaatcatatgag

SEQ ID NO: 6491 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
tgctgactcacatatgtgac

SEQ ID NO: 6492 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ccttacctggagtcatccaa

SEQ ID NO: 6493 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ctcagaaacagaaaatgtga

SEQ ID NO: 6494 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tcaagtctcaactctcagaa

SEQ ID NO: 6495 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ttcctatcaagtctcaactc

SEQ ID NO: 6496 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
gaagtttcattatactaaaa

SEQ ID NO: 6497 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
tgagagttgaaagagatcta

SEQ ID NO: 6498 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
acaggtggccagagatacta

SEQ ID NO: 6499 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
taaatggtgcttttcagggt

SEQ ID NO: 6500 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
gagaacaactgcttgcaatt

SEQ ID NO: 6501 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
gctcagagcaatggagaaga

SEQ ID NO: 6502 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gcttcaacagtcagtcttgc

SEQ ID NO: 6503 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
aaatgttatatattgctctt

SEQ ID NO: 6504 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
ccagatggctataatagaaa

SEQ ID NO: 6505 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
ggaccacccagatggctata

SEQ ID NO: 6506 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
atcatggcaagttgttttac

SEQ ID NO: 6507 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tatttggttgagggagtatc

SEQ ID NO: 6508 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
taaaactaactaacaactat

SEQ ID NO: 6509 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
aaattggggattacagaaga

SEQ ID NO: 6510 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aagactgtggaggagactga

SEQ ID NO: 6511 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
agactagaaaaatttatctg

SEQ ID NO: 6512 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
gaagtatctaaaattataga

SEQ ID NO: 6513 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
actaattttctcaatattgt

SEQ ID NO: 6514 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aagtcacatttgtttttaac

SEQ ID NO: 6515 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
taacaagggtttgatggaca

SEQ ID NO: 6516 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ctctactgatctctctttct

SEQ ID NO: 6517 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
cctccagacaggatactgga

SEQ ID NO: 6518 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
acatgtatgctaattattac

SEQ ID NO: 6519 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
tctcccttaatattgttgtt

SEQ ID NO: 6520 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
aatttctgacagtttaacaa

SEQ ID NO: 6521 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
acctttccttaaggtaagtt

SEQ ID NO: 6522 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
cagagagaatagaccaccgt

SEQ ID NO: 6523 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gtccagagagaataatccag

SEQ ID NO: 6524 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
agcatattactactgtccag

SEQ ID NO: 6525 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
cagatagaatagaccagcat

SEQ ID NO: 6526 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
atccagatagaataggccag

SEQ ID NO: 6527 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
gacatacttccaccatccag

SEQ ID NO: 6528 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
atcaccttcttaattctact

SEQ ID NO: 6529 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
aattatttgcaaatcaaaaa

SEQ ID NO: 6530 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
atgttagtcagtgaaataaa

SEQ ID NO: 6531 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
tgtatatcaaattgtttctc

SEQ ID NO: 6532 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
ttcatctaaaattttatgag

SEQ ID NO: 6533 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
cagaaaaggagatcaatctt

SEQ ID NO: 6534 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ttaatgaattatattgtttt

SEQ ID NO: 6535 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
atcaatgcactaattagact

SEQ ID NO: 6536 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
tagagctggaaattaaagtg

SEQ ID NO: 6537 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gggaacttagaaacttccag

SEQ ID NO: 6538 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
agtttgagtcttctgggaac

SEQ ID NO: 6539 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
atccaatgtttatgtaaagt

SEQ ID NO: 6540 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
cttatccaataatttgcccc

SEQ ID NO: 6541 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tgtttttatttcctcaatca

SEQ ID NO: 6542 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ctcttgcctcaaaataagag

SEQ ID NO: 6543 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
atcactcttgcctcaaaata

SEQ ID NO: 6544 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cacattagtgaaaccaccca

SEQ ID NO: 6545 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
gttttagttatatttgatgt

SEQ ID NO: 6546 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctactcaagaggctgaggca

SEQ ID NO: 6547 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
aaaattaaatgaagtatgaa

SEQ ID NO: 6548 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tctctgctacctgaaaggta

SEQ ID NO: 6549 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
attggtctacaagagctggg

SEQ ID NO: 6550 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
aagcatgggcttgtcagaat

SEQ ID NO: 6551 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
gactgagaagcatgggcttg

SEQ ID NO: 6552 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CGAGAAT
ctacttgtgaggctgaggca

SEQ ID NO: 6553 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
accaagaggccaaaatagat

SEQ ID NO: 6554 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tggcgtttcttccgtgatgt

SEQ ID NO: 6555 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ctatcaatgaatgattggtc

SEQ ID NO: 6556 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
acaaaacaataccccttgct

SEQ ID NO: 6557 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tccaaactgaggccagtata

SEQ ID NO: 6558 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ttcaaaaaacttaaactctt

SEQ ID NO: 6559 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
gacttaaaattctaggataa

SEQ ID NO: 6560 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
aacatgtatggcctgctcct

SEQ ID NO: 6561 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gtgtccatgttacagagatt

SEQ ID NO: 6562 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
tttgcatgcacactaaaatg

SEQ ID NO: 6563 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tggaatctactcactaactc

SEQ ID NO: 6564 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
ttcccagatcaatggaacca

SEQ ID NO: 6565 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tattttacaggatggtgtag

SEQ ID NO: 6566 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gttactcataaagctctggg

SEQ ID NO: 6567 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
ttcacatgtcatttagcaaa

SEQ ID NO: 6568 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gataaagttgtaacttaata

SEQ ID NO: 6569 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
attaatacaaattcatagat

SEQ ID NO: 6570 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
gaatttaatgtggtacccat

SEQ ID NO: 6571 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
ctaggtgataataatagcat

SEQ ID NO: 6572 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ataattatttactccagtta

SEQ ID NO: 6573 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
aaagcctattctatagtttt

SEQ ID NO: 6574 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
aagggcctggtcttaacttc

SEQ ID NO: 6575 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ccaggccaataattcttttt

SEQ ID NO: 6576 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ttaaaagttgttaccagctc

SEQ ID NO: 6577 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
taaagtcagaattctgcaaa

SEQ ID NO: 6578 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
tttcatgaatttagctaaag

SEQ ID NO: 6579 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gttaatgctctcttaaacag

SEQ ID NO: 6580 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ccaagaaaacattgaatgtc

SEQ ID NO: 6581 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ttgaatacttaatgcattcc

SEQ ID NO: 6582 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ttctatataaaggtattctc

SEQ ID NO: 6583 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
aaatatggtgatgcctactg

SEQ ID NO: 6584 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tttaaagaaatgaagataat

SEQ ID NO: 6585 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aacaacagatgattgagttt

SEQ ID NO: 6586 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aggtcctatttataatagca

SEQ ID NO: 6587 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
aaattgatacttccctttta

SEQ ID NO: 6588 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
gcaatcaaagggaaaaccat

SEQ ID NO: 6589 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
atttctactcaagcagtata

SEQ ID NO: 6590 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
cattctaggctctgctcctt

SEQ ID NO: 6591 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ccctgaatgattgcaagaga

SEQ ID NO: 6592 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
cccagaaatctaaatcatgt

SEQ ID NO: 6593 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
ttgtagagacctcaaggggc

SEQ ID NO: 6594 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
ttaccttttaaaaagaatct

SEQ ID NO: 6595 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
cttgaggcattaccttttaa

SEQ ID NO: 6596 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
acattaaaacttagacaaca

SEQ ID NO: 6597 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
cccataattagaatgtgagc

SEQ ID NO: 6598 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aaagttttagttgcccataa

SEQ ID NO: 6599 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tttctctgctagcaatagac

SEQ ID NO: 6600 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
ttgacctcattatttcacca

SEQ ID NO: 6601 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gtgccctaggtagaagattc

SEQ ID NO: 6602 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gtaagttttcatgttattgg

SEQ ID NO: 6603 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
atgatactataggacctggc

SEQ ID NO: 6604 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ctttgcttctcttcttttca

SEQ ID NO: 6605 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gtgggtagtattagtagtta

SEQ ID NO: 6606 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ttctatttatattttcaata

SEQ ID NO: 6607 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
aaaaaaactgaatattcagt

SEQ ID NO: 6608 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ttaatgaatggtcatcctct

SEQ ID NO: 6609 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
attacttttttaccaagctg

SEQ ID NO: 6610 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
aatttttgagaaagctattt

SEQ ID NO: 6611 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tagataaaacatataatttt

SEQ ID NO: 6612 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
tcatagaaaactattttatt

SEQ ID NO: 6613 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gatttagaggcaatattctc

SEQ ID NO: 6614 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ggggcaggaatctctgccaa

SEQ ID NO: 6615 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
atacataatcagatcagtct

SEQ ID NO: 6616 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gaagtaatattactcattga

SEQ ID NO: 6617 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
catgctttcttagtacacat

SEQ ID NO: 6618 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
attgattataaaagtaaaat

SEQ ID NO: 6619 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
gcctgacccactgcaagaaa

SEQ ID NO: 6620 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
cctttctgcctgacccactg

SEQ ID NO: 6621 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
ttcaatttttaaatagtaga

SEQ ID NO: 6622 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
ttgcttgcatttaaggaaaa

SEQ ID NO: 6623 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
tgccacctcaccccctatac

SEQ ID NO: 6624 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tcaatcaagaaatgctaatt

SEQ ID NO: 6625 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ttaaataaaaataagtcaat

SEQ ID NO: 6626 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
gtttttttcaggttgtttcc

SEQ ID NO: 6627 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
ttttttaaaagcactcttct

SEQ ID NO: 6628 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
cttctgcttattactacact

SEQ ID NO: 6629 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
tagaccagaccttacagtat

SEQ ID NO: 6630 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
aattttctatgactctctgc

SEQ ID NO: 6631 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
ccatttttaatctgcaaaaa

SEQ ID NO: 6632 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ttagaaaatatatatgaaaa

SEQ ID NO: 6633 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
gttaatttttacttattgaa

SEQ ID NO: 6634 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
attcctttatgaaaatgtca

SEQ ID NO: 6635 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tatccaatacccaggtagag

SEQ ID NO: 6636 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
tttatatccaatacccaggt

SEQ ID NO: 6637 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
ctctcaggacaatgtattaa

SEQ ID NO: 6638 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tcatgacttattatgttatt

SEQ ID NO: 6639 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tgatgaaattggcaagtgac

SEQ ID NO: 6640 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
aagtaaaactgattttactt

SEQ ID NO: 6641 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
tactacatgccatagaaagg

SEQ ID NO: 6642 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
taatcattatactacatgcc

SEQ ID NO: 6643 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tgactgcgattctaaaagat

SEQ ID NO: 6644 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tttgagaggtggatgcaaaa

SEQ ID NO: 6645 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
cctgggaaaccaatcctgag

SEQ ID NO: 6646 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aaagataaatcttaaggaaa

SEQ ID NO: 6647 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
attaagaatacactgatgga

SEQ ID NO: 6648 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tagatggttattgatacaat

SEQ ID NO: 6649 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
attacaattcaacccacaac

SEQ ID NO: 6650 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aaactcagtggcttacaaca

SEQ ID NO: 6651 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ctatgctctaagcactgtgc

SEQ ID NO: 6652 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
aatactcttttcactgtttc

SEQ ID NO: 6653 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
tgttatctcaaaggtaccca

SEQ ID NO: 6654 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
gagatagtcagtgtcagaat

SEQ ID NO: 6655 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
ctctgaagagatagtcagtg

SEQ ID NO: 6656 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ttttacagtaaaacctctta

SEQ ID NO: 6657 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
tagacagttaaaaatacact

SEQ ID NO: 6658 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ggtttctcaacagagtttat

SEQ ID NO: 6659 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tttttaaatggtctcctcac

SEQ ID NO: 6660 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
acaaagctacagtgagatag

SEQ ID NO: 6661 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
aggtacaaagctacagtgag

SEQ ID NO: 6662 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
ggttgtcatagaagtagata

SEQ ID NO: 6663 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ttaagtgaaatcagccaggc

SEQ ID NO: 6664 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aattgaacgccattcagcca

SEQ ID NO: 6665 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
atgcataaagaaaatgtaca

SEQ ID NO: 6666 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tcgtaaataaataaatgcat

SEQ ID NO: 6667 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
gttgaagagatacagtaaac

SEQ ID NO: 6668 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
ggttctttaaaaaattaaaa

SEQ ID NO: 6669 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
gaatccttacacactgattg

SEQ ID NO: 6670 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
tataagtgtttaaaggatat

SEQ ID NO: 6671 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gatatttctcaaaagaagac

SEQ ID NO: 6672 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
atagagtgaagagataacct

SEQ ID NO: 6673 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aaaactacacaactattaga

SEQ ID NO: 6674 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
aaactgaatagccacatgca

SEQ ID NO: 6675 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aggttccaagtacctataat

SEQ ID NO: 6676 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
aatacataagaatagagagc

SEQ ID NO: 6677 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
cagacacacagagcaataca

SEQ ID NO: 6678 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
tataaagctatagtaaccaa

SEQ ID NO: 6679 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aaataccagtgacattcttt

SEQ ID NO: 6680 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
agatattccatgttcatgga

SEQ ID NO: 6681 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aaaactataaaatattggtg

SEQ ID NO: 6682 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
agctacaaaaaataaaatac

SEQ ID NO: 6683 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aacaacaaataatctgaaaa

SEQ ID NO: 6684 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ccagagcaatcaggcaagag

SEQ ID NO: 6685 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ctagccagagcaatcaggca

SEQ ID NO: 6686 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ttatcaacaaattaagtata

SEQ ID NO: 6687 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
atataatcatctcaatagac

SEQ ID NO: 6688 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
aaactttctatattatatca

SEQ ID NO: 6689 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
acagggacacacacacacga

SEQ ID NO: 6690 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gtaataaaatctctcctagc

SEQ ID NO: 6691 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
acttgccaagactgtatcat

SEQ ID NO: 6692 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
gcctaaatttggatgcaact

SEQ ID NO: 6693 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
gcgtgatgaagatcagtgct

SEQ ID NO: 6694 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
taagaatgccactttttaag

SEQ ID NO: 6695 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ccactaccttgggatatagt

SEQ ID NO: 6696 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gaggcaaattgaattaccca

SEQ ID NO: 6697 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
ctacctgaaaatataagaat

SEQ ID NO: 6698 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gacaaacctacctgaaaata

SEQ ID NO: 6699 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
gggtataaagccatgcagct

SEQ ID NO: 6700 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
tgcctggcagacagttgctc

SEQ ID NO: 6701 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
gtgttcatttcagcttaaag

SEQ ID NO: 6702 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
atgctcaggaggctgaggca

SEQ ID NO: 6703 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tttgttttctctagctcatg

SEQ ID NO: 6704 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
aatcttaaattttaattttt

SEQ ID NO: 6705 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tttaatcttacttagctgta

SEQ ID NO: 6706 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tagtgaatacagcaaagtgg

SEQ ID NO: 6707 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
caacctccagattgcagtga

SEQ ID NO: 6708 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
ttatccgtgtgtgaaaaggt

SEQ ID NO: 6709 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ctactgctacagaaatgaac

SEQ ID NO: 6710 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ttgattaaggcactactgct

SEQ ID NO: 6711 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gaacaaagatctttagcaca

SEQ ID NO: 6712 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
tattctagcacgcttcttgg

SEQ ID NO: 6713 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
taaaactttgcttcaagaga

SEQ ID NO: 6714 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
agaaataaaactttgcttca

SEQ ID NO: 6715 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
gagaaaaaaaaataattaac

SEQ ID NO: 6716 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gacctgcacttctacttcag

SEQ ID NO: 6717 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gctgtctttacttacatctc

SEQ ID NO: 6718 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
gattcccagacctccgacct

SEQ ID NO: 6719 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agacttatgatttttgaagg

SEQ ID NO: 6720 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tttgtgatacccactaggtt

SEQ ID NO: 6721 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
atggaggaactaccaatatc

SEQ ID NO: 6722 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
cttggcaaagaaagtataca

SEQ ID NO: 6723 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tttaattattaattcttggc

SEQ ID NO: 6724 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
ttggtgagtgtttcattcgt

SEQ ID NO: 6725 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ataaaatgcttctgacactt

SEQ ID NO: 6726 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tttaagatgcttattagggc

SEQ ID NO: 6727 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ttttagtatcttctctgtga

SEQ ID NO: 6728 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
ctccgtcgcctcccaaagtg

SEQ ID NO: 6729 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aagaggattcagaagtcagg

SEQ ID NO: 6730 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
aactttcaagcttacaagca

SEQ ID NO: 6731 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
ggcagaggtgaatagctgcc

SEQ ID NO: 6732 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
agtggttaaaataatcaaaa

SEQ ID NO: 6733 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tattgtgtggccctgggagc

SEQ ID NO: 6734 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
gaatagtgataattttaata

SEQ ID NO: 6735 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
atctacaattattaattgca

SEQ ID NO: 6736 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
agctctttggtaagagctac

SEQ ID NO: 6737 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
aaattgatgaaaatgaaaaa

SEQ ID NO: 6738 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aggataaattatcaattcta

SEQ ID NO: 6739 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
atgtatgaaagtattagaaa

SEQ ID NO: 6740 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tgagaaaatgtatgaaagta

SEQ ID NO: 6741 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
attttatctaagtgtcggca

SEQ ID NO: 6742 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
gagtaagaagcttgtggctt

SEQ ID NO: 6743 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tttcctgttttctaatatta

SEQ ID NO: 6744 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
atttacaggactaagttaga

SEQ ID NO: 6745 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ttactctaacagtagtcaga

SEQ ID NO: 6746 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tatagacctaaacatttccc

SEQ ID NO: 6747 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
acgactgcatccctgtgaac

SEQ ID NO: 6748 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
accagttcatttttagggcc

SEQ ID NO: 6749 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
agctttaaaaacaactattt

SEQ ID NO: 6750 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
agtacacacctcacatattt

SEQ ID NO: 6751 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
tgtcagatgaatctgcagcc

SEQ ID NO: 6752 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
ctataaaccttgtttcaata

SEQ ID NO: 6753 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
acagcaagagttttttctgg

SEQ ID NO: 6754 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
gtgatttaatagtaattgat

SEQ ID NO: 6755 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
atgactttgcaaaatgaaaa

SEQ ID NO: 6756 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
taggcacatgaaattcttag

SEQ ID NO: 6757 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ggcacgaccaatcaaataca

SEQ ID NO: 6758 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
attaattcctttaatcctca

SEQ ID NO: 6759 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tatctgaataaattgaacac

SEQ ID NO: 6760 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
agtaattccagaaatttatc

SEQ ID NO: 6761 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
tccctcaataaaaagtaatt

SEQ ID NO: 6762 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
aactatacaactttacaaat

SEQ ID NO: 6763 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
cttgtttgacagactatagc

SEQ ID NO: 6764 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
catttaagagttttttcacc

SEQ ID NO: 6765 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ctacgagtcactaagtggtt

SEQ ID NO: 6766 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
gcttcttatcttgaaaaaat

SEQ ID NO: 6767 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ataatagatcccatttctat

SEQ ID NO: 6768 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
atatatagatagatatcagt

SEQ ID NO: 6769 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
aatggagcagtaactctagg

SEQ ID NO: 6770 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
cagcaaaatgaatggcatta

SEQ ID NO: 6771 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
ataaagagaccattcacact

SEQ ID NO: 6772 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
aaatgttcctgagaaccatt

SEQ ID NO: 6773 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
ttttgaaagaccttatagtt

SEQ ID NO: 6774 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
atcacccgaggcagaatgct

SEQ ID NO: 6775 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
ctaaatgtgtatcacccgag

SEQ ID NO: 6776 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
agaatcagaggacagcatca

SEQ ID NO: 6777 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
atgctgagaaattgtcgaaa

SEQ ID NO: 6778 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
ggagaggaaaagggagatgc

SEQ ID NO: 6779 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
agaagaaacagaagaaagaa

SEQ ID NO: 6780 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaagaaacagaag

SEQ ID NO: 6781 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tgctaaagaaagaagaaaca

SEQ ID NO: 6782 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ctctaaaagtgctaaagaaa

SEQ ID NO: 6783 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aactgagctctaaaagtgct

SEQ ID NO: 6784 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
atatacaagtattaggagaa

SEQ ID NO: 6785 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aagcattctgatcattgtgt

SEQ ID NO: 6786 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
ctttatttcccatgttttta

SEQ ID NO: 6787 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
acatacatataaaaagaatg

SEQ ID NO: 6788 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
aaaattatacatacatataa

SEQ ID NO: 6789 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
ttatcatgaggaaaaatctt

SEQ ID NO: 6790 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ttggaaaattagaaaataac

SEQ ID NO: 6791 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
aaaatttaaattttggaaaa

SEQ ID NO: 6792 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
cattttaataatggtaaaaa

SEQ ID NO: 6793 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gtttgagaaggcttgtacta

SEQ ID NO: 6794 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
taagataaaacatgagatat

SEQ ID NO: 6795 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
atatcatgaggaaaaatctt

SEQ ID NO: 6796 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
ggaaccaattctgggctgag

SEQ ID NO: 6797 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
atttaaaattcttcctagag

SEQ ID NO: 6798 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aagaagctaaacagaaagaa

SEQ ID NO: 6799 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
acattgaagaagctaaacag

SEQ ID NO: 6800 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gcaaacattgaagaagctaa

SEQ ID NO: 6801 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
atactactacacttaataat

SEQ ID NO: 6802 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
tgatgataaagaaagaaaag

SEQ ID NO: 6803 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
attaatatttgatgataaag

SEQ ID NO: 6804 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tattattaatatttgatgat

SEQ ID NO: 6805 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaaattctattttaaaaagc

SEQ ID NO: 6806 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ttatgccaaaaaaaagaaaa

SEQ ID NO: 6807 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cctgcacgttatgccaaaaa

SEQ ID NO: 6808 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ctcagcaaactaaaacagga

SEQ ID NO: 6809 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
ttgcagggacatggatgaag

SEQ ID NO: 6810 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
gaatactatgcagccataaa

SEQ ID NO: 6811 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ccatcaatgatagactggat

SEQ ID NO: 6812 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
acagatgctggagaaaatgt

SEQ ID NO: 6813 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
gtcagaaaataacagatgct

SEQ ID NO: 6814 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
gaatggtgataattaaaaag

SEQ ID NO: 6815 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
gagataccatctcatgccag

SEQ ID NO: 6816 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gctcatcatcactggccatt

SEQ ID NO: 6817 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ctcagcaaactaatacagga

SEQ ID NO: 6818 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
aatactatgcagccattaaa

SEQ ID NO: 6819 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ccatcaatgttaaattgtat

SEQ ID NO: 6820 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
aattccttaaggacctagaa

SEQ ID NO: 6821 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
atagattctggtgaggctat

SEQ ID NO: 6822 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
aatggtgattattaaaaagt

SEQ ID NO: 6823 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
gagataccatctcaagtcag

SEQ ID NO: 6824 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
agctcaacatcagtgatcat

SEQ ID NO: 6825 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
ctcttgtctgattgccctgg

SEQ ID NO: 6826 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
gatgatcgggttttctaaat

SEQ ID NO: 6827 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tccagctttgttctttttgc

SEQ ID NO: 6828 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
attacattatacaattatta

SEQ ID NO: 6829 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ggtcacctttactcaaaatt

SEQ ID NO: 6830 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CGAGAAT
ttttatatttactttatttc

SEQ ID NO: 6831 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
ataacaatgattcacttttc

SEQ ID NO: 6832 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
taggaggttttttatttatt

SEQ ID NO: 6833 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ttaccaacaggtgagtacca

SEQ ID NO: 6834 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
gtacacctgtgtgaaaattg

SEQ ID NO: 6835 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ttcaatattgtccccctata

SEQ ID NO: 6836 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
cacagacagacttatgcctt

SEQ ID NO: 6837 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ctattccaagaattatacag

SEQ ID NO: 6838 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
ttattgactctaatctattc

SEQ ID NO: 6839 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaccagtccaccaattttag

SEQ ID NO: 6840 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
gaaaaaccagtccaccaatt

SEQ ID NO: 6841 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
ttgctgttcccagaagaatc

SEQ ID NO: 6842 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
ggataaggttgctgttccca

SEQ ID NO: 6843 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ttttaagaatattgtatata

SEQ ID NO: 6844 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ggacttgggtacacatattt

SEQ ID NO: 6845 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
gaaggtagaaaatgttactt

SEQ ID NO: 6846 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
gtcatataaatcttaagaag

SEQ ID NO: 6847 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
taaaggctgaaagagaagga

SEQ ID NO: 6848 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
actgttcaaattcttcttca

SEQ ID NO: 6849 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
aatatttgagggagaatata

SEQ ID NO: 6850 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
attatcaataaatatttgag

SEQ ID NO: 6851 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ttagtttaaatatcatctcc

SEQ ID NO: 6852 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
acgtcctaatgatgcatttc

SEQ ID NO: 6853 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
gaatgaaaagtaagataatt

SEQ ID NO: 6854 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
cattgtcatctcctcaacac

SEQ ID NO: 6855 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
ttactactaaaaattagcac

SEQ ID NO: 6856 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
taggaagtcaggttcttata

SEQ ID NO: 6857 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
atagaagcaacattcaaatc

SEQ ID NO: 6858 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
cctgtttttgagcagctagt

SEQ ID NO: 6859 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ataatttaatgtctagttgt

SEQ ID NO: 6860 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
cgtgattcattctttatctt

SEQ ID NO: 6861 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
aatattttcatctttcccac

SEQ ID NO: 6862 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
aattaatttaaaaacttcac

SEQ ID NO: 6863 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
agttgtctttctgagcaagg

SEQ ID NO: 6864 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
tctaatatttgacatttaat

SEQ ID NO: 6865 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
agctaaatgtgcagtattat

SEQ ID NO: 6866 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
agaacttggttgatagatca

SEQ ID NO: 6867 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tatatggtcatatcagggca

SEQ ID NO: 6868 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
aaattctacagatgatttga

SEQ ID NO: 6869 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
cctgagagtgcaaatgagga

SEQ ID NO: 6870 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
aaatttggctataaagggaa

SEQ ID NO: 6871 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
atatgtgtagacaattctcc

SEQ ID NO: 6872 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
acaggggtgaaaagaagagg

SEQ ID NO: 6873 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gtaagtggtagggttcaagg

SEQ ID NO: 6874 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gaagtcatcagagaatttct

SEQ ID NO: 6875 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
taagtaacagggaagtcatc

SEQ ID NO: 6876 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaggagtaaggatgatgaag

SEQ ID NO: 6877 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gatcaaggagtaaggatgat

SEQ ID NO: 6878 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
gtagaaacagatgtgcttgt

SEQ ID NO: 6879 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ccaagagaagaaaacatatt

SEQ ID NO: 6880 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tataaataatgaagccaaga

SEQ ID NO: 6881 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gaggacccagaaaagaacac

SEQ ID NO: 6882 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
attcaggtagaaaagaggac

SEQ ID NO: 6883 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ctctgacatttagaattcag

SEQ ID NO: 6884 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aagatctacaactctgacat

SEQ ID NO: 6885 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
cctgatatttttaagtagat

SEQ ID NO: 6886 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aattccagagcaatcagcaa

SEQ ID NO: 6887 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
agagaattggagatttaagt

SEQ ID NO: 6888 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
tccaggtggatatataatat

SEQ ID NO: 6889 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gagtgatggcagagaaatga

SEQ ID NO: 6890 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gtttcatctagagtgatggc

SEQ ID NO: 6891 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ttgcttctctcatctaggca

SEQ ID NO: 6892 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
gggtagatggtagatgggaa

SEQ ID NO: 6893 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
gaatggcaacagagaaagta

SEQ ID NO: 6894 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gagaaaggaagaatggcaac

SEQ ID NO: 6895 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
cgtggtttggtaagagaaag

SEQ ID NO: 6896 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aacagcagcgtggtttggta

SEQ ID NO: 6897 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
taaagggagggtatgggttt

SEQ ID NO: 6898 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
ggggggtgctgcttcaatta

SEQ ID NO: 6899 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctactcaggaggctgaggca

SEQ ID NO: 6900 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tacaaaaaaagaagaaaaaa

SEQ ID NO: 6901 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
taaaaaataatacaaaaaaa

SEQ ID NO: 6902 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tacaagaatatactaataga

SEQ ID NO: 6903 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
gctgagacagctacttgtta

SEQ ID NO: 6904 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
atgagcaggagtatttatag

SEQ ID NO: 6905 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ggttttcttaacctttgtta

SEQ ID NO: 6906 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
gaaacttatttccaatggat

SEQ ID NO: 6907 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
gaaaaaaatagaagccttaa

SEQ ID NO: 6908 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aaaagactataaataaaatg

SEQ ID NO: 6909 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
agatatcaaagtttagttca

SEQ ID NO: 6910 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aaaaaagaattattttctct

SEQ ID NO: 6911 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
cctaatttctatatcataaa

SEQ ID NO: 6912 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tttcaaagctattcaaatat

SEQ ID NO: 6913 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
agtgaagaagactttagaag

SEQ ID NO: 6914 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
cacttgaaaataatgaaaca

SEQ ID NO: 6915 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
ttgacaacctaggtattctt

SEQ ID NO: 6916 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gggctgactttgatcttttg

SEQ ID NO: 6917 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
tttaattctacaggtattta

SEQ ID NO: 6918 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ttaaaatagaagccccaaac

SEQ ID NO: 6919 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gagaagtttaacaaccccaa

SEQ ID NO: 6920 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ttccatctgctacctgctgc

SEQ ID NO: 6921 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tcttttcccaaatgtattta

SEQ ID NO: 6922 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ttgcaagaggcttctgtgta

SEQ ID NO: 6923 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
atgtcttccagtggttaatt

SEQ ID NO: 6924 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
agatgctacagtgttttctc

SEQ ID NO: 6925 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tatgatattaacctgctaga

SEQ ID NO: 6926 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aaaatagtctacaagctcat

SEQ ID NO: 6927 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
ttctcctttcagtcctctaa

SEQ ID NO: 6928 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
cttcaatataacactgccat

SEQ ID NO: 6929 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cacagttattgttactggtg

SEQ ID NO: 6930 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
attagtattataactaaaat

SEQ ID NO: 6931 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
gaatggctacaataacattt

SEQ ID NO: 6932 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
aagtcatcttcctgccaacc

SEQ ID NO: 6933 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ctgataaccctatataaaat

SEQ ID NO: 6934 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
acggtgagaaatgcttattg

SEQ ID NO: 6935 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gacttacctcctgaatacgg

SEQ ID NO: 6936 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
ccatgtcaatacaattgcag

SEQ ID NO: 6937 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
caaaccatgtcaatacaatt

SEQ ID NO: 6938 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
cttaacatggtgcaggagag

SEQ ID NO: 6939 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tctgaatggcaggggaggcc

SEQ ID NO: 6940 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cctgagactgggtaatttat

SEQ ID NO: 6941 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
aatcacttaaaagtttttaa

SEQ ID NO: 6942 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gtagttttttccagttctgt

SEQ ID NO: 6943 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
ttattcttgtgatagtttac

SEQ ID NO: 6944 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
gttcaattcccacctatgag

SEQ ID NO: 6945 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
tatatatatatataggatat

SEQ ID NO: 6946 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
agtgaataaccatatcatga

SEQ ID NO: 6947 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tcaaaggaacccaaagaaga

SEQ ID NO: 6948 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gaaaatcaaaggaacccaaa

SEQ ID NO: 6949 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cattgaacaacgcattgctg

SEQ ID NO: 6950 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
gggaatttaggaaaatttac

SEQ ID NO: 6951 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
ttgaagtgacagcagaggat

SEQ ID NO: 6952 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gttgcttctgattgataagc

SEQ ID NO: 6953 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tggtggaaatagcaagagaa

SEQ ID NO: 6954 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
cagatgtggtggaaatagca

SEQ ID NO: 6955 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
taatcattcagaaaatctct

SEQ ID NO: 6956 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
taattatattatttaatcat

SEQ ID NO: 6957 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
taactatattatttaattat

SEQ ID NO: 6958 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ataattatattctttactat

SEQ ID NO: 6959 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ataattatattatttactat

SEQ ID NO: 6960 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ataattatattatttactat

SEQ ID NO: 6961 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tattaataattatttactat

SEQ ID NO: 6962 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
gaattatattatttaattat

SEQ ID NO: 6963 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
aatttatcgttcagaaaatc

SEQ ID NO: 6964 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
agcaaatgctaatttatcgt

SEQ ID NO: 6965 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
actagaagaatatattatag

SEQ ID NO: 6966 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
ggtctaacagccttctacta

SEQ ID NO: 6967 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aacagccttattgcaaatat

SEQ ID NO: 6968 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tccagtgaacacatgaatga

SEQ ID NO: 6969 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
ttctcactttaaatcagaag

SEQ ID NO: 6970 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
cccctaatgttcaagtaaag

SEQ ID NO: 6971 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
cataacttactctttacctt

SEQ ID NO: 6972 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
acaatcatcattatgtagtt

SEQ ID NO: 6973 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
atggtaccctccagttgaat

SEQ ID NO: 6974 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
agaggagaataggaatattg

SEQ ID NO: 6975 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ttgggggagacagagacaga

SEQ ID NO: 6976 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
ccatttaaatatttactcca

SEQ ID NO: 6977 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
agtattcattttcactttta

SEQ ID NO: 6978 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gtatattttctttcttctgg

SEQ ID NO: 6979 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
aaattgtaaattaaacatga

SEQ ID NO: 6980 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gtgagtgggtaagatagtaa

SEQ ID NO: 6981 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
actataggaaatcttagata

SEQ ID NO: 6982 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
catagaaaataagaaagagt

SEQ ID NO: 6983 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
gtgtctgcatacatagaaaa

SEQ ID NO: 6984 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
atatgtgtgtgtctgcatac

SEQ ID NO: 6985 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ctttgactggaaagatgtgt

SEQ ID NO: 6986 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
atctgtgacttctctgctag

SEQ ID NO: 6987 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
agaaatctgtgacttctctg

SEQ ID NO: 6988 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
atctacatcacatatttgcc

SEQ ID NO: 6989 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ataatctattaatatttatg

SEQ ID NO: 6990 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
tcacaaagcatgacctttac

SEQ ID NO: 6991 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
tatagaacgtttctagcacc

SEQ ID NO: 6992 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
ttaaaattctcctaaaatat

SEQ ID NO: 6993 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
gttaatgctctaaactttca

SEQ ID NO: 6994 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
tgataataggttgtctgata

SEQ ID NO: 6995 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
aattttgaattttcttatac

SEQ ID NO: 6996 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tatggctatttacacgttct

SEQ ID NO: 6997 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gtgtcagatggtcccttgaa

SEQ ID NO: 6998 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
tgttcagtattcatctaagc

SEQ ID NO: 6999 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
acatctcaaagctcactatg

SEQ ID NO: 7000 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
atgaatgatgcttaaaatgt

SEQ ID NO: 7001 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
catgcctcaaaagaacttgg

SEQ ID NO: 7002 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
ctccaaattaagaagaaact

SEQ ID NO: 7003 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ttacaaaagctccaaattaa

SEQ ID NO: 7004 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
atgcctcaacatttttagaa

SEQ ID NO: 7005 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tcctaaatgcctcaacattt

SEQ ID NO: 7006 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tgaaatgatgggaattttct

SEQ ID NO: 7007 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agcaatattcaatgaataaa

SEQ ID NO: 7008 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
ctgcttccaatatttgactt

SEQ ID NO: 7009 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
catactctaactgagccaca

SEQ ID NO: 7010 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
ttatctgggagatattttta

SEQ ID NO: 7011 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tagtccctctaatcaagatt

SEQ ID NO: 7012 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tattttcctgctccttgaaa

SEQ ID NO: 7013 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tattttcctgctccttgaaa

SEQ ID NO: 7014 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
gttctgattctatggtgcct

SEQ ID NO: 7015 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
gagtataggttaggtatttt

SEQ ID NO: 7016 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
attattacctttatttaata

SEQ ID NO: 7017 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
cctcccaggcatgattactt

SEQ ID NO: 7018 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tgacccaggagagtgcattt

SEQ ID NO: 7019 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gttaaattgtacttattcta

SEQ ID NO: 7020 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ctcacagttcctaaagtaac

SEQ ID NO: 7021 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
gtgttcagagctcagtaaaa

SEQ ID NO: 7022 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
ctttatcttgttattgacat

SEQ ID NO: 7023 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
aggtatttagattagtaaaa

SEQ ID NO: 7024 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tctaatatgctctcataaaa

SEQ ID NO: 7025 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
taactatggcttactttgat

SEQ ID NO: 7026 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
ttgtgcagccacaaaatctt

SEQ ID NO: 7027 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ataagacagaaattctcaag

SEQ ID NO: 7028 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tttatttttatcaaaataag

SEQ ID NO: 7029 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tgagtgagaccttgtgttta

SEQ ID NO: 7030 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
agtaagataaaacaagataa

SEQ ID NO: 7031 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
agtgtacctagcaccttgtt

SEQ ID NO: 7032 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
aaacacagaattccttcact

SEQ ID NO: 7033 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
accaatactgggatgaaaac

SEQ ID NO: 7034 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
aattctctcaacttgagttt

SEQ ID NO: 7035 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
acaaataatggtaagggatt

SEQ ID NO: 7036 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ttgaaagtcaaaataagatt

SEQ ID NO: 7037 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gatggtgttttctacacaac

SEQ ID NO: 7038 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ttaatcttttgtagtttaat

SEQ ID NO: 7039 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
aagactagacaagtacagga

SEQ ID NO: 7040 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
gcatcctttaaaatttttaa

SEQ ID NO: 7041 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
acttgaggttaaaaaaatct

SEQ ID NO: 7042 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
gaatgggatatgggggcaat

SEQ ID NO: 7043 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
tgaaaaacaggtagagtggc

SEQ ID NO: 7044 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aatattcaattttcaagaaa

SEQ ID NO: 7045 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
tgtgtacaatattcaatttt

SEQ ID NO: 7046 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tagtaaataaaaacaaacaa

SEQ ID NO: 7047 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
caaaaatgaagggaagtcct

SEQ ID NO: 7048 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
caaagtaaagggaagatcaa

SEQ ID NO: 7049 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cactatactcagttgtggta

SEQ ID NO: 7050 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aaaaacaagttgtaaaactc

SEQ ID NO: 7051 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tatcttacaactcatatgtg

SEQ ID NO: 7052 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aaggatgagcaataaaataa

SEQ ID NO: 7053 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
gaaggaagattggatattgg

SEQ ID NO: 7054 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
caagttcaaagtaaagggca

SEQ ID NO: 7055 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
aaagatattgattacaagca

SEQ ID NO: 7056 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
attaattttcaagtgattca

SEQ ID NO: 7057 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
agttttggactgtggatatt

SEQ ID NO: 7058 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gtgatttcatttttaaaaac

SEQ ID NO: 7059 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tataataaaatataatttta

SEQ ID NO: 7060 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
taactccacctggaggtagg

SEQ ID NO: 7061 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
aaaaacatttccatttatgg

SEQ ID NO: 7062 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tcatcgaggaaattttcaga

SEQ ID NO: 7063 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
gccaatcatcgaggaaattt

SEQ ID NO: 7064 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
atgaatgttgaatggagaaa

SEQ ID NO: 7065 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
ctcattaatgaatgttgaat

SEQ ID NO: 7066 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
tttgatcctttaatggaaca

SEQ ID NO: 7067 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
tgaaatgtattttatccctt

SEQ ID NO: 7068 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
cgaaatcatactttaattct

SEQ ID NO: 7069 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
ctctttaatagatgcagttg

SEQ ID NO: 7070 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
tctgttcagactctactaat

SEQ ID NO: 7071 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
attgccagtaaagaaattgt

SEQ ID NO: 7072 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tcagtaaagtaattgccagt

SEQ ID NO: 7073 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
agatgagtcttcagaaacaa

SEQ ID NO: 7074 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
cacgccttccagatgagtct

SEQ ID NO: 7075 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
atctactgccgtaataaaaa

SEQ ID NO: 7076 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aataaaatcacatcttattg

SEQ ID NO: 7077 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tgatttcctcaacttgtacc

SEQ ID NO: 7078 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
acaatggatgtgcattaaac

SEQ ID NO: 7079 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
catcattatttatcattaac

SEQ ID NO: 7080 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
ttttcatattcaagaaagga

SEQ ID NO: 7081 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ctgtgcttatttttcatatt

SEQ ID NO: 7082 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
cattcattaggaaataatga

SEQ ID NO: 7083 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
agggaacaccaaaagcacag

SEQ ID NO: 7084 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
aaaatgtttacctctacaaa

SEQ ID NO: 7085 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
ttggtggatatattggaagc

SEQ ID NO: 7086 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
atcctcctagtttcctctca

SEQ ID NO: 7087 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tggcttgcacttttcagcct

SEQ ID NO: 7088 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctgaaaagactcccatacaa

SEQ ID NO: 7089 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ttaatataaagagcaccgaa

SEQ ID NO: 7090 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aattgtcaggtcacgaaaga

SEQ ID NO: 7091 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tgcccaattgtcaggtcacg

SEQ ID NO: 7092 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
gatttccgaagagcagtgtg

SEQ ID NO: 7093 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ctattacttgtttgtgcctt

SEQ ID NO: 7094 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
gtaagatctaaattaaaaat

SEQ ID NO: 7095 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
atatcatttattggggtgaa

SEQ ID NO: 7096 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
aatttcaaagagaaatgtca

SEQ ID NO: 7097 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
atagtagaattaaatttcaa

SEQ ID NO: 7098 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
atatgctacctctctagata

SEQ ID NO: 7099 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tgttaaaatggcatgttttg

SEQ ID NO: 7100 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
caagaatcagtagtagtagt

SEQ ID NO: 7101 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
tttttaaaaaattcaaaaac

SEQ ID NO: 7102 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaaaaaaagaaagagaaag

SEQ ID NO: 7103 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaaagaaaaaaagaaagag

SEQ ID NO: 7104 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
agaaagaaagaaaaaaagaa

SEQ ID NO: 7105 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaaa

SEQ ID NO: 7106 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aggaaggaaaagaaagaaag

SEQ ID NO: 7107 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gggaaggaaggaaaagaaag

SEQ ID NO: 7108 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gagagggaaggaaggaaaag

SEQ ID NO: 7109 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aggagagagggaaggaagga

SEQ ID NO: 7110 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gaaagaaagaaagggaaaga

SEQ ID NO: 7111 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaaagaaagaaagaaaggg

SEQ ID NO: 7112 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7113 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7114 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7115 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7116 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7117 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7118 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7119 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7120 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7121 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagaaagaaagaaagaaag

SEQ ID NO: 7122 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaaaaagaaagaaagaaag

SEQ ID NO: 7123 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaaagaaaaagaaagaaag

SEQ ID NO: 7124 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaaagaaagaaaaagaaag

SEQ ID NO: 7125 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ggaaagaaagaaagaaaaag

SEQ ID NO: 7126 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gaaaggaaagaaagaaagaa

SEQ ID NO: 7127 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaagagaaaggaaagaaag

SEQ ID NO: 7128 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaaagaagagaaaggaaag

SEQ ID NO: 7129 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaaaagaaagaagagaaagg

SEQ ID NO: 7130 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
acactatcaaaaaagaaaga

SEQ ID NO: 7131 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cacagaaatacactatcaaa

SEQ ID NO: 7132 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tgcactacagcctgggtgac

SEQ ID NO: 7133 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
cttggcatatatttgtacat

SEQ ID NO: 7134 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
tgcagttataaaaataaaat

SEQ ID NO: 7135 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
atcaatgcacataataatac

SEQ ID NO: 7136 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tttccaaaggaaatagttct

SEQ ID NO: 7137 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aatctcaatgtcacctttgg

SEQ ID NO: 7138 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ttcccacagcaactgtgaac

SEQ ID NO: 7139 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagcaattaagaaaataat

SEQ ID NO: 7140 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
gctgttagtaaaaaagcaat

SEQ ID NO: 7141 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
acaaaacaatataagagaga

SEQ ID NO: 7142 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
caaacatttatgccacacat

SEQ ID NO: 7143 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
gactctattctaaacgtgag

SEQ ID NO: 7144 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
tttcaattaatctgatgttg

SEQ ID NO: 7145 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
tttagttaattttacaggct

SEQ ID NO: 7146 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
gtgctcttttttcacctcac

SEQ ID NO: 7147 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tttttgaaataaaacattga

SEQ ID NO: 7148 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
atttaatttttttctttttc

SEQ ID NO: 7149 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
gcttgactttgagatgatgt

SEQ ID NO: 7150 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
agacatgttatcacatgcaa

SEQ ID NO: 7151 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
taatctgttatctcacaagt

SEQ ID NO: 7152 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
aaaagacttagcatttctcc

SEQ ID NO: 7153 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
aattagattatttgttgtgg

SEQ ID NO: 7154 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
aaaggattgtaggtggcttt

SEQ ID NO: 7155 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CGAGAAA
aaagcttccatttagttcct

SEQ ID NO: 7156 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
taattttgtcatgatgtcct

SEQ ID NO: 7157 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
aataacatgttctaattgtt

SEQ ID NO: 7158 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
aatttagtagccattttagt

SEQ ID NO: 7159 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctcaaaagcccagaggagca

SEQ ID NO: 7160 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
tttatggcctatggtctttt

SEQ ID NO: 7161 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
acaggttcactaatgaggga

SEQ ID NO: 7162 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
aggcttttccaagacaagta

SEQ ID NO: 7163 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
agagcatctcacatttatta

SEQ ID NO: 7164 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
agatgtcagcaaattgatgt

SEQ ID NO: 7165 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aagatcccaaaggagaataa

SEQ ID NO: 7166 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
aaaaaataaaagatcccaaa

SEQ ID NO: 7167 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
tgtaggtgtaattggaaaca

SEQ ID NO: 7168 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
aatagctctttactaagtca

SEQ ID NO: 7169 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
catgaactttaaatgcctgt

SEQ ID NO: 7170 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ggaaagggtttagggttgat

SEQ ID NO: 7171 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
atagtacagataaaagataa

SEQ ID NO: 7172 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
tcttggactggctcctgagg

SEQ ID NO: 7173 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
cggccactactttggaggtt

SEQ ID NO: 7174 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ccattgggctaaatatggga

SEQ ID NO: 7175 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ttctttttaaagtaaggaat

SEQ ID NO: 7176 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
aataaataaaatgagactat

SEQ ID NO: 7177 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
ttgtagagagattctaattt

SEQ ID NO: 7178 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
ggagtagaaaagttttcaaa

SEQ ID NO: 7179 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
gacaagtccacgaaccagga

SEQ ID NO: 7180 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
catgcaggaataatagaatc

SEQ ID NO: 7181 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
aaattatccatgcaggaata

SEQ ID NO: 7182 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
ttaaaggcagaatgcccaga

SEQ ID NO: 7183 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
caaagagaaagctgttaaag

SEQ ID NO: 7184 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ggtggggacattacacacaa

SEQ ID NO: 7185 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
cagtgggcaagatgattgac

SEQ ID NO: 7186 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
acccacatcttttgcttgaa

SEQ ID NO: 7187 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
cctaatggctaactgtgact

SEQ ID NO: 7188 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tccaatctaatcaagaaggg

SEQ ID NO: 7189 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
cgtgtttcttaagaaacgcc

SEQ ID NO: 7190 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ttaacattgtacgtgtttct

SEQ ID NO: 7191 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
taatatttctatacttcagt

SEQ ID NO: 7192 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
taagaaaaaattaacccatt

SEQ ID NO: 7193 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tcccacaatgttactgcaac

SEQ ID NO: 7194 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
agtatcttgatcagtatata

SEQ ID NO: 7195 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tggcaacagaatggagcagc

SEQ ID NO: 7196 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
attatcaattgttggtggca

SEQ ID NO: 7197 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
gaacttttaaatcttggttt

SEQ ID NO: 7198 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
atttgtgatgttttaataag

SEQ ID NO: 7199 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
agaaatttgtgatgttttaa

SEQ ID NO: 7200 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaagcacagatcttttttca

SEQ ID NO: 7201 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
acagacattagccaccacgc

SEQ ID NO: 7202 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
gacctttggggaaattaaac

SEQ ID NO: 7203 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
aaagggaacattatgaggat

SEQ ID NO: 7204 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
caaagcagactggagatatg

SEQ ID NO: 7205 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tgaaggagacaggcgtgatg

SEQ ID NO: 7206 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tcttggaacactgaaaaatc

SEQ ID NO: 7207 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
tgttttaatttttttaatga

SEQ ID NO: 7208 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
tggggaaacaggttgtaata

SEQ ID NO: 7209 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gatttgtgtaatcccaaatt

SEQ ID NO: 7210 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
agacactgaccaaagaagaa

SEQ ID NO: 7211 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
agaaaataatgaatatttca

SEQ ID NO: 7212 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
acacacaatcccttggcaaa

SEQ ID NO: 7213 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaactggcaaaagaaaaaaa

SEQ ID NO: 7214 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
taaaagatgacaaactggca

SEQ ID NO: 7215 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
catttctaggcctatgtttc

SEQ ID NO: 7216 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
catgccactgcactccagac

SEQ ID NO: 7217 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ctactcaggaggctgaggca

SEQ ID NO: 7218 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ggatgacccaaacactgaga

SEQ ID NO: 7219 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gaggtggatgacccaaacac

SEQ ID NO: 7220 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agaatagagtcatctgcatt

SEQ ID NO: 7221 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
agtattaatataaggtttat

SEQ ID NO: 7222 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ttattcttcaaaaataaata

SEQ ID NO: 7223 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
ctgggaaacattgaagagtg

SEQ ID NO: 7224 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
atagggtattatttgcatga

SEQ ID NO: 7225 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gtagctttatacatgctgat

SEQ ID NO: 7226 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cacaaaagagtaggttaaaa

SEQ ID NO: 7227 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
ccgtactgtgaaactattca

SEQ ID NO: 7228 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gcgttacactaggtaacaaa

SEQ ID NO: 7229 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
atcagcagagttagggtagg

SEQ ID NO: 7230 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
gaggaatgttcatgtctttt

SEQ ID NO: 7231 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tgaggagtgaggaaattgaa

SEQ ID NO: 7232 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
gcaagctttattcgatggcc

SEQ ID NO: 7233 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ttggtattggagacccaata

SEQ ID NO: 7234 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
gaaaatgcaaactaaaatga

SEQ ID NO: 7235 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gatccctgacctcactcaca

SEQ ID NO: 7236 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
agactacatacagacagagc

SEQ ID NO: 7237 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
aaatatttgtattgtatacc

SEQ ID NO: 7238 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
agataaactaccataaacca

SEQ ID NO: 7239 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAA
tataaaacacaggagccact

SEQ ID NO: 7240 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
acacttatgaagtacttgaa

SEQ ID NO: 7241 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
tacaaaccacaaaactgcta

SEQ ID NO: 7242 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gtagcatcttaaataggttg

SEQ ID NO: 7243 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
gaaatagacatagttacata

SEQ ID NO: 7244 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
attggaagaaaatacgatat

SEQ ID NO: 7245 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
cctacatagatagttcattg

SEQ ID NO: 7246 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
caatcccaatgaaaataaaa

SEQ ID NO: 7247 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
ctaagaaataataattattt

SEQ ID NO: 7248 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tctaccaaattaagcatttc

SEQ ID NO: 7249 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tattttaataatcatagaat

SEQ ID NO: 7250 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
atcacaatattttaataatc

SEQ ID NO: 7251 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aggtatacaaaatcaactta

SEQ ID NO: 7252 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
ctgagttgaaagctccctaa

SEQ ID NO: 7253 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
tttatcaaacctgatggatt

SEQ ID NO: 7254 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
acaatgtccacaaatgttcc

SEQ ID NO: 7255 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tccaagagagagcagagaaa

SEQ ID NO: 7256 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ctttagttccaagagagagc

SEQ ID NO: 7257 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
ttttaacaacaacaacagaa

SEQ ID NO: 7258 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
atatatttttaacaacaaca

SEQ ID NO: 7259 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
tgccccaaaatggcagaaag

SEQ ID NO: 7260 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAA
gaaaattctgccccaaaatg

SEQ ID NO: 7261 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
gcctatgcacttgctttatc

SEQ ID NO: 7262 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tgaacaggtcaattcatcag

SEQ ID NO: 7263 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
agatcaatgatttctactat

SEQ ID NO: 7264 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaattgaattaatgagtaag

SEQ ID NO: 7265 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aaacaaattgaattaatgag

SEQ ID NO: 7266 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
ttaggagaattcctgatggg

SEQ ID NO: 7267 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
ataaatatactagcaattta

SEQ ID NO: 7268 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
tttttccctatgatattttc

SEQ ID NO: 7269 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
tttaggatgtataccctaaa

SEQ ID NO: 7270 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
catccgggtcgtagcatata

SEQ ID NO: 7271 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
tggacatgggtaacataaaa

SEQ ID NO: 7272 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ttgatgtatttaaggagaag

SEQ ID NO: 7273 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
agggagctagctaaacaact

SEQ ID NO: 7274 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gaaaaacaataaaacaggac

SEQ ID NO: 7275 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ttaacaggtagactggcaga

SEQ ID NO: 7276 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
aaatgtggtctgtatataaa

SEQ ID NO: 7277 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tcatcaacagataaaagagt

SEQ ID NO: 7278 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAT
atatgatccagcaattgaaa

SEQ ID NO: 7279 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
aaaggtgttgttgagaatgt

SEQ ID NO: 7280 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
aaaaaagtgaaaggtgttgt

SEQ ID NO: 7281 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gaagtttattctgaaatgga

SEQ ID NO: 7282 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
aacagagcgagactcagtct

SEQ ID NO: 7283 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GGAGAAT
cttctcgggaggctgaggca

SEQ ID NO: 7284 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAA
ggaaaaaggccttccccaag

SEQ ID NO: 7285 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gctaatagaaaacaacaaaa

SEQ ID NO: 7286 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
aaatcatgtaattacagcta

SEQ ID NO: 7287 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
gaaagaaatcttatatattc

SEQ ID NO: 7288 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
atacacatttcttttatagg

SEQ ID NO: 7289 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
tgaggtgagaacactaaggc

SEQ ID NO: 7290 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
gtatctaggcatttaataac

SEQ ID NO: 7291 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
atgagtaaaacagggaaaaa

SEQ ID NO: 7292 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAT
tcttcttgagagtctatact

SEQ ID NO: 7293 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aattggaaaattgagcctct

SEQ ID NO: 7294 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
aggattgttcacttggaaat

SEQ ID NO: 7295 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ctatatctttttagttctat

SEQ ID NO: 7296 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gaaggaaatggctttaggca

SEQ ID NO: 7297 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
agagcatccagagaatgtgg

SEQ ID NO: 7298 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gaggatttatgagagcatcc

SEQ ID NO: 7299 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAT
atgattgtgtcattttcata

SEQ ID NO: 7300 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAA
tgcttatgtgagctcagttg

SEQ ID NO: 7301 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
gtttaaatctgtatcatcta

SEQ ID NO: 7302 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
aaatgtattaaaatatattt

SEQ ID NO: 7303 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
aagtaatttgtaatgcattc

SEQ ID NO: 7304 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
atacaaaaatatggattctt

SEQ ID NO: 7305 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAT
cttcattgttgacttagctt

SEQ ID NO: 7306 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gaggaagaagaagaggagaa

SEQ ID NO: 7307 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GTAGAAT
tctctgtggcaaggaaaaaa

SEQ ID NO: 7308 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gagtacctgatgcttctaca

SEQ ID NO: 7309 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAT
aatatggtatttgatgtaaa

SEQ ID NO: 7310 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
tatcaacaacaaaactctag

SEQ ID NO: 7311 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
gttgggaagttcagttcttt

SEQ ID NO: 7312 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
gatgttaagagcaatttaca

SEQ ID NO: 7313 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CTAGAAA
acaaaaatcagaacaagaaa

SEQ ID NO: 7314 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
attcaagacaaaaatcagaa

SEQ ID NO: 7315 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
tagtgaaattcagaaaagat

SEQ ID NO: 7316 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TCAGAAA
taagcactttatagtgaaat

SEQ ID NO: 7317 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
agcagatacaacctgtgggg

SEQ ID NO: 7318 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
cccctgagcaacaggagccc

SEQ ID NO: 7319 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GAAGAAA
gttgtgagcaaagccctacg

SEQ ID NO: 7320 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
tatacatatatataaagaaa

SEQ ID NO: 7321 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ttttatatatacatatatat

SEQ ID NO: 7322 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
gattcttcactgcatcttcg

SEQ ID NO: 7323 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAA
ggaaatttcctgtttctctt

SEQ ID NO: 7324 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ccaggacaaatctcagaagc

SEQ ID NO: 7325 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
caatagcacatcttacaagt

SEQ ID NO: 7326 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
atttgtccaggatatggcac

SEQ ID NO: 7327 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAT
aaaataaaattttaaaaata

SEQ ID NO: 7328 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ATAGAAT
ttatatatttgcctaacccc

SEQ ID NO: 7329 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAT
gagatgaataagtggaacac

SEQ ID NO: 7330 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
ggaatattattcagcactgt

SEQ ID NO: 7331 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
cttaaaactcaacaacaaga

SEQ ID NO: 7332 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
taaagcttaaaactcaacaa

SEQ ID NO: 7333 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAT
atgcattatatattccactc

SEQ ID NO: 7334 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TGAGAAT
taacaagaacctagatatat

SEQ ID NO: 7335 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
aaataaatagttggaacatg

SEQ ID NO: 7336 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AAAGAAA
tagactaggaatggcacata

SEQ ID NO: 7337 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAA
ttctagggctgccaaaagag

SEQ ID NO: 7338 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TAAGAAA
ctgtgcagtgtagtatttaa

SEQ ID NO: 7339 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CCAGAAA
actgtctattttttgttctt

SEQ ID NO: 7340 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: AGAGAAA
ttttctaatcctatttaatt

SEQ ID NO: 7341 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAT
tttattcttctattttcaca

SEQ ID NO: 7342 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: ACAGAAA
ttttgatcaaaaataactcc

SEQ ID NO: 7343 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: TTAGAAA
ccatcttcctgagctgtggt

SEQ ID NO: 7344 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: GCAGAAT
atttttgttttcacacaatt

SEQ ID NO: 7345 - DNA, 20 bp, synthetic construct
  source 1..20: mol_type = other DNA; note = Description of Artificial Sequence: Synthetic oligonucleotide; note = Target: SCN9A; (-) strand; PAM type: NNAGAAW; PAM sequence: CAAGAAT
tactatccctgtgtgaggtc

SEQ ID NO: 7346 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
acaggacagccactcacaac

SEQ ID NO: 7347 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aatatcaagattgccaatat

SEQ ID NO: 7348 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tattgagaaactcaggcctt

SEQ ID NO: 7349 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
aataaatgtctgattttaat

SEQ ID NO: 7350 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
catgtatagtctctctcagg

SEQ ID NO: 7351 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
cagaaagcactggcactgta

SEQ ID NO: 7352 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
actggcactgtataagaatg

SEQ ID NO: 7353 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
ttgttgagaagatcctgcaa

SEQ ID NO: 7354 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgagaagatcctgcaaacag

SEQ ID NO: 7355 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
taaaatctttgctgaggatt

SEQ ID NO: 7356 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gaatttatcatcataataat

SEQ ID NO: 7357 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
cataataatggagaaatatt

SEQ ID NO: 7358 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
atccactctggctactgtac

SEQ ID NO: 7359 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
gaatagatttggaagtgagg

SEQ ID NO: 7360 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
tatttacattacattaggtg

SEQ ID NO: 7361 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
ggattggcttctggactccc

SEQ ID NO: 7362 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
tttccccaactatttctgat

SEQ ID NO: 7363 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
gaattggttgaatccacaga

SEQ ID NO: 7364 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
accatgagattagtattcct

SEQ ID NO: 7365 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
tcctccatttgaagacacag

SEQ ID NO: 7366 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ctcctcagcctcgggaactg

SEQ ID NO: 7367 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ccttccttaaatgtattgac

SEQ ID NO: 7368 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
cttcagattctctttgactt

SEQ ID NO: 7369 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
aaatttgtaaggtgctttgc

SEQ ID NO: 7370 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
tcaagagtagcctaagaaca

SEQ ID NO: 7371 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tgaagggccagccataagta

SEQ ID NO: 7372 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
cagattatgttctcacatat

SEQ ID NO: 7373 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
aattatgatggtatattaga

SEQ ID NO: 7374 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tagagaagaattatattttt

SEQ ID NO: 7375 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
gaagaattatatttttatag

SEQ ID NO: 7376 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
atagcattatctacaatgtg

SEQ ID NO: 7377 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gcctagtatggcaattattt

SEQ ID NO: 7378 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tatacttacccatataaaat

SEQ ID NO: 7379 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
tcttctcctcattttataga

SEQ ID NO: 7380 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
agttgaggcccatataggtt

SEQ ID NO: 7381 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
cagctttcccatctgtaaaa

SEQ ID NO: 7382 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
tactccatgtggttgtaagg

SEQ ID NO: 7383 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tagaatgagacaagctacac

SEQ ID NO: 7384 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
gaaattagaacaatgacaat

SEQ ID NO: 7385 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
gaacaatgacaatacagaat

SEQ ID NO: 7386 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ccaatttgctactaaaaatg

SEQ ID NO: 7387 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
acaaaccttgatgtggattt

SEQ ID NO: 7388 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
ctatggttattctaactgaa

SEQ ID NO: 7389 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
catagatctatgaaatttgt

SEQ ID NO: 7390 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ctggtcacttaaaaaagttt

SEQ ID NO: 7391 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
atatatttttgaaatgctaa

SEQ ID NO: 7392 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aaggcaatgtaaaaacatta

SEQ ID NO: 7393 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
gaatgaacctaagatggtat

SEQ ID NO: 7394 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tgtgcatgaataactttata

SEQ ID NO: 7395 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
ggcaaaatatatttcacatc

SEQ ID NO: 7396 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
gtggcaagagagcaagttgg

SEQ ID NO: 7397 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gatgactaaacaatactgca

SEQ ID NO: 7398 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
ttgaggagtgtaatatgtac

SEQ ID NO: 7399 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gaacaaaaagggatatgaaa

SEQ ID NO: 7400 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
aagatgaatgaaaaacattt

SEQ ID NO: 7401 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
taaattggttctgatgcaat

SEQ ID NO: 7402 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
aaatttaagcacctcaaaat

SEQ ID NO: 7403 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
agagttctcttacgattctt

SEQ ID NO: 7404 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CGAGAAT
gttagtgactgcactgcctt

SEQ ID NO: 7405 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
tttcttccatctgtgaacga

SEQ ID NO: 7406 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
atgatgatataactaacaaa

SEQ ID NO: 7407 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
acagtcgggtggcttactgt

SEQ ID NO: 7408 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
atacgtttcaatcaaatcag

SEQ ID NO: 7409 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
cctgtatgtggaggaaaata

SEQ ID NO: 7410 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gcaattacttaaaaaaggat

SEQ ID NO: 7411 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aaaggattaagaaattccaa

SEQ ID NO: 7412 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
cataatagtgttttacattt

SEQ ID NO: 7413 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
taagaatgatacctactcac

SEQ ID NO: 7414 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gcaataccgttaaatgctaa

SEQ ID NO: 7415 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
atatatagctgaacctatct

SEQ ID NO: 7416 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tttatgatgattttttcccc

SEQ ID NO: 7417 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tttacaaatttgtgttttgc

SEQ ID NO: 7418 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
ctatttccacatatttccta

SEQ ID NO: 7419 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
tctatatgtcttaatatttt

SEQ ID NO: 7420 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
taattttcttccagatgaat

SEQ ID NO: 7421 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
ctgacttaataggaatgctt

SEQ ID NO: 7422 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttaaaagtttataattctaa

SEQ ID NO: 7423 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
acaacaacaaaaacaagaag

SEQ ID NO: 7424 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
taacttcactttaaattctg

SEQ ID NO: 7425 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gtataatttccttctaatag

SEQ ID NO: 7426 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
ttggggcctgtagtgtaaac

SEQ ID NO: 7427 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
ctcaagagtaaatttgtgtt

SEQ ID NO: 7428 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atccttggattttgttctgc

SEQ ID NO: 7429 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
gattttgttctgcaaagaaa

SEQ ID NO: 7430 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
gtaaacttttcaagtattat

SEQ ID NO: 7431 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
agatgtgcattaaaaatgaa

SEQ ID NO: 7432 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gatgtcttgacctccaaggt

SEQ ID NO: 7433 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
aaaaataaatgtagttaaaa

SEQ ID NO: 7434 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ataggttaaaatgtgttaat

SEQ ID NO: 7435 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
tcttaaataattacatatgt

SEQ ID NO: 7436 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
cttactgtgacttttattgc

SEQ ID NO: 7437 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
tttattgctaagaaaatttg

SEQ ID NO: 7438 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
caaatatttagaacttttat

SEQ ID NO: 7439 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
cccattcacaattactacaa

SEQ ID NO: 7440 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
aaagaggacacaaacaaatg

SEQ ID NO: 7441 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
aacagaacagaacagaggcc

SEQ ID NO: 7442 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
ggaaaactggctagccatat

SEQ ID NO: 7443 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ctaaaaccataaaaacccta

SEQ ID NO: 7444 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taaagagcttctgcaaagca

SEQ ID NO: 7445 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tcagagtgaacaggcaacct

SEQ ID NO: 7446 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aacaggcaacctacagaatg

SEQ ID NO: 7447 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
tctgacaaaagggctaatat

SEQ ID NO: 7448 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aaagaacttaaacaaattta

SEQ ID NO: 7449 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gctcatcatcactggtcatc

SEQ ID NO: 7450 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gagataccacctcatgccaa

SEQ ID NO: 7451 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
acagatgttggagaggatgt

SEQ ID NO: 7452 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
aagacagtgtgatgattcct

SEQ ID NO: 7453 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gattcctcaagaatctaaaa

SEQ ID NO: 7454 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ccatcaataatagactggat

SEQ ID NO: 7455 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gctttgggagggattactta

SEQ ID NO: 7456 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
cttaaagtataataataaaa

SEQ ID NO: 7457 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
acatttctatatctctattt

SEQ ID NO: 7458 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
actttccaattgattacata

SEQ ID NO: 7459 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
attagtataatccatataat

SEQ ID NO: 7460 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cagacttcatgtcaatgtca

SEQ ID NO: 7461 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
agaacttgacagaagaagct

SEQ ID NO: 7462 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
agaagctggagaaaaactga

SEQ ID NO: 7463 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ggagaaaactccaactttga

SEQ ID NO: 7464 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
atcctggttgtcaatatgat

SEQ ID NO: 7465 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
agattatgaattaattcaat

SEQ ID NO: 7466 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
gataaattgaggtaatgcat

SEQ ID NO: 7467 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tagtaaaatagggttggtta

SEQ ID NO: 7468 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
atgcaaagcacaaggaacac

SEQ ID NO: 7469 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ggaaacaacaaaaagggata

SEQ ID NO: 7470 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aatccgcagttactgaccct

SEQ ID NO: 7471 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
agatttataaattgcctaaa

SEQ ID NO: 7472 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atgaggatatcaatgaaggg

SEQ ID NO: 7473 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
tcagtaaaaactctggaatt

SEQ ID NO: 7474 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
atagcagacttgatcaaact

SEQ ID NO: 7475 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
cagacttgatcaaactggag

SEQ ID NO: 7476 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
tggagaaagaatcaacaaac

SEQ ID NO: 7477 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gctcatcatcactggccatc

SEQ ID NO: 7478 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gagataccatctcataccag

SEQ ID NO: 7479 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
acaggtgctggagaggatgt

SEQ ID NO: 7480 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gattcctcaaggatctagaa

SEQ ID NO: 7481 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ccaacaatgatagactggat

SEQ ID NO: 7482 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ttatccagtcagtggagcaa

SEQ ID NO: 7483 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
attatgaaatcacagagaag

SEQ ID NO: 7484 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
catctaaattcaggaaactc

SEQ ID NO: 7485 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
tactcgggaggctgaggcag

SEQ ID NO: 7486 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gaaactctatctcggaaaaa

SEQ ID NO: 7487 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ctctatctcggaaaaaaaag

SEQ ID NO: 7488 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aaagggaagtttgaaagcag

SEQ ID NO: 7489 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
agtatatattcaaaatactt

SEQ ID NO: 7490 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
taaagaaaaaaactgctgac

SEQ ID NO: 7491 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
aggtaaatacatggacaaat

SEQ ID NO: 7492 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
aagttaaatgtcaaaataat

SEQ ID NO: 7493 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
aaaattacaaaaatgtgttt

SEQ ID NO: 7494 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aggaaaatccacgtaaaaat

SEQ ID NO: 7495 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
taaaaatacagaaataaaaa

SEQ ID NO: 7496 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cacaaaagaagacagttaag

SEQ ID NO: 7497 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
gacagttaagagagaaaaag

SEQ ID NO: 7498 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
agagagaaaaagacagaaaa

SEQ ID NO: 7499 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
cagaaaaaaagaattacaaa

SEQ ID NO: 7500 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ccagatactcgtttcagatt

SEQ ID NO: 7501 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
tgataaaaaagatacatttt

SEQ ID NO: 7502 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
accaaatggatcacaaacac

SEQ ID NO: 7503 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
taccatcttttcaagtgcgc

SEQ ID NO: 7504 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tcttgaaaaagcaatgggtc

SEQ ID NO: 7505 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gatacatgtctacattataa

SEQ ID NO: 7506 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
tagatttacatgtctaggaa

SEQ ID NO: 7507 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
tagagctaagtaagtgaaat

SEQ ID NO: 7508 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aaatagagaataaaaaagca

SEQ ID NO: 7509 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
atagaaaaagtcaacaaaac

SEQ ID NO: 7510 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aaatccttagcaagcataac

SEQ ID NO: 7511 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
gaggactcaaatatgtaaaa

SEQ ID NO: 7512 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
gtaaaaccagaaatgaaaga

SEQ ID NO: 7513 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
caagactgaatcatgaggaa

SEQ ID NO: 7514 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taatgatagtaactcccaaa

SEQ ID NO: 7515 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
agtccaaccaaacatttaaa

SEQ ID NO: 7516 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
tcgaaagtcattttatgggg

SEQ ID NO: 7517 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aaagccagacaaagacactg

SEQ ID NO: 7518 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
cagacaaagacactgtaaga

SEQ ID NO: 7519 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cacatggatcagttctctcc

SEQ ID NO: 7520 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
tcagttctctccagagaaac

SEQ ID NO: 7521 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
ccagagaaacccagaatcca

SEQ ID NO: 7522 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aaactcatgcacaccagagg

SEQ ID NO: 7523 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
aaatacccatatcaaaatgg

SEQ ID NO: 7524 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gcacagtgccttacatttgg

SEQ ID NO: 7525 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tgcagctacttcccaagggt

SEQ ID NO: 7526 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ttaaggaaatgtatttattt

SEQ ID NO: 7527 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
tggaaatctacatagcaaat

SEQ ID NO: 7528 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
gacatgaaactagaagtcaa

SEQ ID NO: 7529 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tgaacaggcaatgggtcaaa

SEQ ID NO: 7530 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
agaagaaattatacggaaaa

SEQ ID NO: 7531 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
gataacaaatagtatggaat

SEQ ID NO: 7532 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
atgtagaaaaagaagccctg

SEQ ID NO: 7533 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tagtaataaatgcctacatt

SEQ ID NO: 7534 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ctaatattacatcttagaga

SEQ ID NO: 7535 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tagagattagaaaaagaaga

SEQ ID NO: 7536 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
atccccaaactttgcagaag

SEQ ID NO: 7537 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
agaaaataacaaagataatg

SEQ ID NO: 7538 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tagaaggaatgaactaatct

SEQ ID NO: 7539 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
gcaacctaccaagactaaat

SEQ ID NO: 7540 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgaacaaaccaatactggat

SEQ ID NO: 7541 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aaaaccctaagagtatgcta

SEQ ID NO: 7542 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
cctaagagtatgctaccaga

SEQ ID NO: 7543 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
cacttctttttgacatagta

SEQ ID NO: 7544 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ccatagcaattaggcaggaa

SEQ ID NO: 7545 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
agaaataaaatacatccatg

SEQ ID NO: 7546 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aatacatccatgtaagaaag

SEQ ID NO: 7547 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
taatgacatgatctttatat

SEQ ID NO: 7548 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ttgcagtttgcaaaatcaac

SEQ ID NO: 7549 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttaacaatgaggtatccaac

SEQ ID NO: 7550 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gaggtatccaacaaagaaat

SEQ ID NO: 7551 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
tatttcatgttcatgtgttg

SEQ ID NO: 7552 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aaattctaatgtcagttttc

SEQ ID NO: 7553 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aatggaaaaggataaaaagc

SEQ ID NO: 7554 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
ttgattttcagcaaaggtgc

SEQ ID NO: 7555 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aactgaatattccttatgca

SEQ ID NO: 7556 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
acaagtaaaagacttaaata

SEQ ID NO: 7557 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
atgaaactataaagctacta

SEQ ID NO: 7558 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
agctactagaagaaaacata

SEQ ID NO: 7559 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
aagctcaagcaactcaacac

SEQ ID NO: 7560 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
agaaaatcaataaaccaatt

SEQ ID NO: 7561 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
atgctcaacatctctaatca

SEQ ID NO: 7562 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
gaaatattacctcacacctc

SEQ ID NO: 7563 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
acaagtgttgatgaggatgt

SEQ ID NO: 7564 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tgtaaattagtacagctgtt

SEQ ID NO: 7565 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ccatcaacaggtgaatgaat

SEQ ID NO: 7566 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
ctaagcaaaattagccaggt

SEQ ID NO: 7567 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aaaagtgagaagtcaacatt

SEQ ID NO: 7568 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
ggactgggggaagacgatgt

SEQ ID NO: 7569 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taaagagcttctgcacagca

SEQ ID NO: 7570 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
acagagtaagcagacagtct

SEQ ID NO: 7571 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
agcagacagtctacagaatg

SEQ ID NO: 7572 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
atctgacaaaggtctaatat

SEQ ID NO: 7573 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aaggaacttaaatgagttta

SEQ ID NO: 7574 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gctcaatgtcactgaccatt

SEQ ID NO: 7575 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
gagataccatctcacaccag

SEQ ID NO: 7576 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
acagatgctggcgagggtgt

SEQ ID NO: 7577 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tggcgagggtgtggagaaaa

SEQ ID NO: 7578 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aattcctcaaagacctaaag

SEQ ID NO: 7579 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
ctattcacaatggcaaagac

SEQ ID NO: 7580 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
attagtaaactaaggcagga

SEQ ID NO: 7581 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tgtatatttcaaaattgcta

SEQ ID NO: 7582 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aaaaatgaacaaatatttaa

SEQ ID NO: 7583 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tttcatggtaaaaactaaaa

SEQ ID NO: 7584 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
gcaatttaattgcaattgtg

SEQ ID NO: 7585 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
tttaagaggtgtttaagtta

SEQ ID NO: 7586 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cagcactagaagtcctagcc

SEQ ID NO: 7587 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
tcctagccagagaaattagg

SEQ ID NO: 7588 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gtaaaagacatcccaatctg

SEQ ID NO: 7589 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
actaacaataaacaatctga

SEQ ID NO: 7590 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aatctgaagagaaaattagg

SEQ ID NO: 7591 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tcccatttatgataacatca

SEQ ID NO: 7592 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ctgaatagccaaagcaatct

SEQ ID NO: 7593 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
taagaaaaaagaacaaaatg

SEQ ID NO: 7594 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aatgaaacaggatagagagc

SEQ ID NO: 7595 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
ctcatattcaacaggggtgc

SEQ ID NO: 7596 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aggggtgccaagaatacaca

SEQ ID NO: 7597 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tgaaaactgtaaaacttgta

SEQ ID NO: 7598 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
agagggtgaaaaagcaacct

SEQ ID NO: 7599 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aaaaagcaacctatagaatg

SEQ ID NO: 7600 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
atgctcagtatcactaatca

SEQ ID NO: 7601 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctacttgggaagctgaggca

SEQ ID NO: 7602 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctacacgggaggctgaggca

SEQ ID NO: 7603 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
ataggtgttggcaaggatat

SEQ ID NO: 7604 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tgtaaaatgatgtagctgcc

SEQ ID NO: 7605 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gtctattgatgaatgatggg

SEQ ID NO: 7606 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aatttatgctgagtgaagta

SEQ ID NO: 7607 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
caaactcatggaaacagaga

SEQ ID NO: 7608 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
tgccagggcatgaaaggatg

SEQ ID NO: 7609 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
gcatgaaaggatgggagaat

SEQ ID NO: 7610 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taattaaaattaggaaaggc

SEQ ID NO: 7611 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gttttttcagggaagagtgg

SEQ ID NO: 7612 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
ggaaagaaattctaaatcat

SEQ ID NO: 7613 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tctaaatcattcagaaaagg

SEQ ID NO: 7614 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
gattgcaagatgaaatactg

SEQ ID NO: 7615 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
atcctattttacttcctgca

SEQ ID NO: 7616 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ttcctgcagtagaaatgttg

SEQ ID NO: 7617 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tgtatatataatgcttaagt

SEQ ID NO: 7618 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
agagtatctcagttagttga

SEQ ID NO: 7619 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
cagttagttgacaagaaact

SEQ ID NO: 7620 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ttttttgtaaagctcagtct

SEQ ID NO: 7621 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
aagtcctaacccttagcact

SEQ ID NO: 7622 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
ctggcatccttactagtaga

SEQ ID NO: 7623 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ggagttctgttgccataaac

SEQ ID NO: 7624 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
ttctaacctccaaaagtgtg

SEQ ID NO: 7625 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttatcctgttctcgtaggtc

SEQ ID NO: 7626 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tataggaaacattggaaaaa

SEQ ID NO: 7627 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
agttagccagaacctattat

SEQ ID NO: 7628 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ccaatgaacaagttcaaagt

SEQ ID NO: 7629 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
gcttggatgatatggtacag

SEQ ID NO: 7630 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
gataatcaatacttacatta

SEQ ID NO: 7631 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
catcccttaaaagttgcctt

SEQ ID NO: 7632 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
tgcctttaagaataacatta

SEQ ID NO: 7633 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
ttataattaatatactattt

SEQ ID NO: 7634 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
cccatgatgctgaatatcag

SEQ ID NO: 7635 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tcacaacgacctagtattca

SEQ ID NO: 7636 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aacgacctagtattcaaaag

SEQ ID NO: 7637 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gatgttaaataggcaacatg

SEQ ID NO: 7638 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
gccatgcagacataaataaa

SEQ ID NO: 7639 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atctgtacactctggaaaaa

SEQ ID NO: 7640 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
agcattaaagattcccccat

SEQ ID NO: 7641 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
gacattctccacaaaaggat

SEQ ID NO: 7642 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ttctcaagatgctttaaaat

SEQ ID NO: 7643 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
agattaggaggaataggaat

SEQ ID NO: 7644 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
atgatggaatcatgggtctc

SEQ ID NO: 7645 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
ttgtaattttcaacttgtag

SEQ ID NO: 7646 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
agtaggtctggggtgagatc

SEQ ID NO: 7647 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
ttttaggtgtctgaacagag

SEQ ID NO: 7648 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
atagcaggtataaatctgga

SEQ ID NO: 7649 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
catgaggatatggactaatt

SEQ ID NO: 7650 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
cagcctatgtatttatgtaa

SEQ ID NO: 7651 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgtttgccactaaagtaacc

SEQ ID NO: 7652 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
aagaaggttaaccaaaataa

SEQ ID NO: 7653 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aagttgtttattctatttga

SEQ ID NO: 7654 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
ctaccaaatagtttttcatg

SEQ ID NO: 7655 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
aaatcacaattgtactgaag

SEQ ID NO: 7656 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
attaccataaccagtatcca

SEQ ID NO: 7657 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gttcttatcgtaaattatct

SEQ ID NO: 7658 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gtgtagcaggagacgatgtc

SEQ ID NO: 7659 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
agagattcaatttttcgagg

SEQ ID NO: 7660 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
tatatttatctatttcaggc

SEQ ID NO: 7661 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
ttcctaaagctacgtattta

SEQ ID NO: 7662 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tatgtatgctccctctttaa

SEQ ID NO: 7663 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ctctctggtgtgcccaccag

SEQ ID NO: 7664 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
cttcccagcttccagaactt

SEQ ID NO: 7665 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
actatggtatagtttgtaac

SEQ ID NO: 7666 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
ttcaaataacccagaagcct

SEQ ID NO: 7667 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
ttctgaaatctgaatataca

SEQ ID NO: 7668 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
agtatgtcttggggttgggg

SEQ ID NO: 7669 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tagataagtttctatacttt

SEQ ID NO: 7670 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
aaaatttgcatctctgtcag

SEQ ID NO: 7671 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
gaacaggaggttatactcac

SEQ ID NO: 7672 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cccgtcatatttacagttta

SEQ ID NO: 7673 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
catatttacagtttaagaga

SEQ ID NO: 7674 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aatgattaattgaaaaatag

SEQ ID NO: 7675 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
aatcattactatatccgaag

SEQ ID NO: 7676 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
attttttcacattacatatt

SEQ ID NO: 7677 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
catttaatatgttgtgtgat

SEQ ID NO: 7678 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
atgaagctttgaataacagt

SEQ ID NO: 7679 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
gttaggtttctgaaaatcta

SEQ ID NO: 7680 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
agataaagaacatatcattc

SEQ ID NO: 7681 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
attgaggttataaaataatg

SEQ ID NO: 7682 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
gttaaaataatatgtaaact

SEQ ID NO: 7683 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ttgtatttgtataatgattt

SEQ ID NO: 7684 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
aaattttgttttattcttaa

SEQ ID NO: 7685 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
taaaaaatcacatctccttt

SEQ ID NO: 7686 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
attataaatgttacaatgtc

SEQ ID NO: 7687 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tggctgtgttaatatttcta

SEQ ID NO: 7688 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ggttttttcacaacacacag

SEQ ID NO: 7689 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
tatccattttagaagcattt

SEQ ID NO: 7690 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ctgctggtcttcagaggtca

SEQ ID NO: 7691 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
agaggtcaagagaaagtgca

SEQ ID NO: 7692 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
gcggtgcttcctatgctttc

SEQ ID NO: 7693 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tcagccacatgtcccttgac

SEQ ID NO: 7694 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
aaactgttggtatcaatatt

SEQ ID NO: 7695 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
aagaaaagagacaagttggg

SEQ ID NO: 7696 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gactggtcccagagcaggaa

SEQ ID NO: 7697 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
tggatgtaggagcaaggagg

SEQ ID NO: 7698 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
agggttgtttgaaaattaaa

SEQ ID NO: 7699 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
atttatttaaaatacacttt

SEQ ID NO: 7700 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
caggttgttggggagtgtgc

SEQ ID NO: 7701 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
cctgggtaaagggggaacca

SEQ ID NO: 7702 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
tcagcaggaaaaatgacaat

SEQ ID NO: 7703 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
ggaagctgcttgtatgtgta

SEQ ID NO: 7704 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tgcttgtatgtgtacaagaa

SEQ ID NO: 7705 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
cctcagcctgccttgcctaa

SEQ ID NO: 7706 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ctccattgctctgagctcct

SEQ ID NO: 7707 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
cagggtacaaaacattactc

SEQ ID NO: 7708 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tttatcttttagctcatttt

SEQ ID NO: 7709 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aacctccatacacaacctga

SEQ ID NO: 7710 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
tgcatgttaaatcttgatat

SEQ ID NO: 7711 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tacacctttctaaacaatat

SEQ ID NO: 7712 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aactcctgaaattaagttca

SEQ ID NO: 7713 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
ttttggttaggtagataaaa

SEQ ID NO: 7714 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gggttcattttgatagcatg

SEQ ID NO: 7715 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
atctcacctggcttatttct

SEQ ID NO: 7716 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ggcagcaaaaattgttatgc

SEQ ID NO: 7717 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gcatagaaatttaaaccagt

SEQ ID NO: 7718 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
agtttagaattgtgatgcaa

SEQ ID NO: 7719 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ggcaagggtgagaggtgagc

SEQ ID NO: 7720 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gaatagagaggagtaggggt

SEQ ID NO: 7721 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
gggtgaagaaagtttcatac

SEQ ID NO: 7722 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ttgattggatatcaaatgta

SEQ ID NO: 7723 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ctgaaacgggaaaaacctgt

SEQ ID NO: 7724 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
acgggaaaaacctgtctaga

SEQ ID NO: 7725 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
aaaaagagtatttagggtga

SEQ ID NO: 7726 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
tgaaacaacaatattaaggg

SEQ ID NO: 7727 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
caattcttgttgttaaactg

SEQ ID NO: 7728 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
aaatatttgactatataaac

SEQ ID NO: 7729 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
gagcttcttgattttctaga

SEQ ID NO: 7730 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
agttcaaaaaaagcattctt

SEQ ID NO: 7731 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tttgagaaacaatttgatat

SEQ ID NO: 7732 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
acatcactaggacaggtaga

SEQ ID NO: 7733 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gaccaagagggtgcagtaaa

SEQ ID NO: 7734 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
gagctatgaacataagaggc

SEQ ID NO: 7735 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
tgaacataagaggcccagaa

SEQ ID NO: 7736 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
tttaaagtttattaaagcaa

SEQ ID NO: 7737 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
aaagcaactagaattactct

SEQ ID NO: 7738 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
gaaggcaggaggtgggaaag

SEQ ID NO: 7739 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
tatgttctaaaacaacaaaa

SEQ ID NO: 7740 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
ctcttgacaagatgcacctg

SEQ ID NO: 7741 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gcactttaatttccagctct

SEQ ID NO: 7742 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttacataaacattggatgaa

SEQ ID NO: 7743 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
tttaatattaacttagtgct

SEQ ID NO: 7744 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ttaaaaacaatgatcacata

SEQ ID NO: 7745 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aaacaatgatcacatataag

SEQ ID NO: 7746 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ctcaggggcaaattattgga

SEQ ID NO: 7747 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
aaaaacactaaaaatcctaa

SEQ ID NO: 7748 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
taattgaatgtaaacataac

SEQ ID NO: 7749 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaaaaaaaaaaaaggaaagg

SEQ ID NO: 7750 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaaaaaggaaaggaaagaaa

SEQ ID NO: 7751 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttgttaacattatctttcca

SEQ ID NO: 7752 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taacattatctttccaaaag

SEQ ID NO: 7753 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
tggttattgtgttactaaag

SEQ ID NO: 7754 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tggcttctcctaccaagtta

SEQ ID NO: 7755 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
agctaatttttgtattttta

SEQ ID NO: 7756 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aacaaccttgcataagaggg

SEQ ID NO: 7757 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
cacctctcacctggatttat

SEQ ID NO: 7758 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ctggatttatgcagaaactc

SEQ ID NO: 7759 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tcaattttctttacatcacg

SEQ ID NO: 7760 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aattatttgtttactggaat

SEQ ID NO: 7761 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
ccaacttctttctagttatc

SEQ ID NO: 7762 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atgatatttggtgtgtattt

SEQ ID NO: 7763 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
tgcttaacccatgaatgtta

SEQ ID NO: 7764 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
gaatgttataagaaaccagt

SEQ ID NO: 7765 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
acttctgtataagattgtta

SEQ ID NO: 7766 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
agattgttaacagaatcctt

SEQ ID NO: 7767 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ttaacagaatccttgaagaa

SEQ ID NO: 7768 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ctgacaaattccagaagtag

SEQ ID NO: 7769 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
gtagtaagaaattcagcata

SEQ ID NO: 7770 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tgatgttaagagtcaatagc

SEQ ID NO: 7771 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
gcatgaaacacctcagagct

SEQ ID NO: 7772 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aacacctcagagcttcagaa

SEQ ID NO: 7773 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
actgaagattgaacatgtgg

SEQ ID NO: 7774 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
aatcattatttacaggatgt

SEQ ID NO: 7775 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gtgcagaaaaaatactcatt

SEQ ID NO: 7776 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
gcctctgaaactaaggaaag

SEQ ID NO: 7777 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gagcttgaccggtttaatct

SEQ ID NO: 7778 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
atataacattttagtatata

SEQ ID NO: 7779 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aacagtattatttataatgt

SEQ ID NO: 7780 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
caaactctgaaacaaagatc

SEQ ID NO: 7781 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
acacatacacacacacacac

SEQ ID NO: 7782 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gtttaatttaaaataagata

SEQ ID NO: 7783 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
actgaatattctataaaact

SEQ ID NO: 7784 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
taggctttaaagtataaact

SEQ ID NO: 7785 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
caggcccttcatttctgaaa

SEQ ID NO: 7786 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
agcagtgagaggaattgctg

SEQ ID NO: 7787 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
gtgagaggaattgctgatag

SEQ ID NO: 7788 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
aaataaaatgattcttattt

SEQ ID NO: 7789 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tcaattgaattcagcttggc

SEQ ID NO: 7790 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
caatattattgttcaatggg

SEQ ID NO: 7791 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
gcttctttagcagatttcta

SEQ ID NO: 7792 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ttctaagagaatacctttat

SEQ ID NO: 7793 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tccatgtaattttggaaatg

SEQ ID NO: 7794 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gaaataaatgctttagtatg

SEQ ID NO: 7795 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ccccttgaggtaatcgagag

SEQ ID NO: 7796 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
ttttctactatactgcttga

SEQ ID NO: 7797 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tgataatctaacgctcaaaa

SEQ ID NO: 7798 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
tcaacaaaaaccttactcaa

SEQ ID NO: 7799 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
tattctttaaggagcagagc

SEQ ID NO: 7800 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aaaatactcacaaaagacag

SEQ ID NO: 7801 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gaggagatgggtataaaaga

SEQ ID NO: 7802 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ctccattatctgttaataag

SEQ ID NO: 7803 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
aggatcaaaggatcctttga

SEQ ID NO: 7804 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gcctttatttttttccttct

SEQ ID NO: 7805 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
atgttacttccactaattta

SEQ ID NO: 7806 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ctctttttttaaaaaaaggg

SEQ ID NO: 7807 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tttctttgtctattgctagc

SEQ ID NO: 7808 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gtcaaatctcagccaccacc

SEQ ID NO: 7809 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
tcagccaccaccagagaaat

SEQ ID NO: 7810 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
acggagacctcttctttttc

SEQ ID NO: 7811 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaatgataagatatgaatat

SEQ ID NO: 7812 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
agaactgctacactgtttgc

SEQ ID NO: 7813 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
atctataattttgaaacaaa

SEQ ID NO: 7814 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ttctaatattgaaaatataa

SEQ ID NO: 7815 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
acagcttggtaaaaaagtaa

SEQ ID NO: 7816 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ctatgcatgtatatatattt

SEQ ID NO: 7817 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tccttatttaggctctagtt

SEQ ID NO: 7818 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
tggaataaaatagttttcta

SEQ ID NO: 7819 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aaatccccaccaaatttgaa

SEQ ID NO: 7820 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
acaaacatctcaacaatgac

SEQ ID NO: 7821 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
agtatgtattttaatacatt

SEQ ID NO: 7822 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tgatctgattatgtatataa

SEQ ID NO: 7823 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ccaactttctagatgtgtac

SEQ ID NO: 7824 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
gcttatccataaatacataa

SEQ ID NO: 7825 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
cagaattattaaatacaaag

SEQ ID NO: 7826 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
tctgagattttatatttatg

SEQ ID NO: 7827 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
gttacatcaagaagtcatca

SEQ ID NO: 7828 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
actttcttgcagtgggtcag

SEQ ID NO: 7829 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
agaaggttaggtactgaatt

SEQ ID NO: 7830 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
ttaaagtcatatacctgtaa

SEQ ID NO: 7831 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
ttccaaatttatcaaaatat

SEQ ID NO: 7832 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
aaaaaatctatgcataaaat

SEQ ID NO: 7833 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ctttgattaaaaatctaaag

SEQ ID NO: 7834 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tttcatgagtgtaatttagg

SEQ ID NO: 7835 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ataattctgggcagagagtc

SEQ ID NO: 7836 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttctctactatgcacaaata

SEQ ID NO: 7837 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
taacataatatttatgtaat

SEQ ID NO: 7838 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
taagaaataagattatacag

SEQ ID NO: 7839 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tagtaactgcatctcttaaa

SEQ ID NO: 7840 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
ccttccaaggtatcttacca

SEQ ID NO: 7841 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
taatcataggcattaatata

SEQ ID NO: 7842 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
ggatgttttaaaatatgaaa

SEQ ID NO: 7843 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
cagttaaacagagtcctgac

SEQ ID NO: 7844 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
caaagagagcaaagtgatgt

SEQ ID NO: 7845 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
cagcaaggttttcacctaga

SEQ ID NO: 7846 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aggaaagggttatgtagtct

SEQ ID NO: 7847 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aagggttatgtagtcttgag

SEQ ID NO: 7848 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gaagggaataagatagtttt

SEQ ID NO: 7849 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
ggtggattagaagcacaata

SEQ ID NO: 7850 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aaatgtacaataccattaca

SEQ ID NO: 7851 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
tacaccattacagaggtata

SEQ ID NO: 7852 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
ccaaatcttttcttaatctt

SEQ ID NO: 7853 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
catccaatgaatggtgtgga

SEQ ID NO: 7854 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tataactggggtccttataa

SEQ ID NO: 7855 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gaaaagaccgagacacacag

SEQ ID NO: 7856 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
attgccaacaacctccaaag

SEQ ID NO: 7857 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ggatacttactagagccttt

SEQ ID NO: 7858 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tctagcctccagaactggca

SEQ ID NO: 7859 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ctaatttgttacaacagccg

SEQ ID NO: 7860 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tcagttcagtgcctgcattc

SEQ ID NO: 7861 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aaattctccataaactctgt

SEQ ID NO: 7862 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tatacccatagcccctgaat

SEQ ID NO: 7863 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tgaataaagaaaataatatc

SEQ ID NO: 7864 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
ggcatttctttgtcttcttt

SEQ ID NO: 7865 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
ctttttttttttttttctgt

SEQ ID NO: 7866 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
agattatttgttgttaacat

SEQ ID NO: 7867 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
atcagatcatataaaaacaa

SEQ ID NO: 7868 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tatcttgttccagatcttgg

SEQ ID NO: 7869 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tttcattctgttgatataat

SEQ ID NO: 7870 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
attggggtaatattggcctt

SEQ ID NO: 7871 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ggccttgtagaatgaattta

SEQ ID NO: 7872 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
atttttttggaataatttaa

SEQ ID NO: 7873 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
agttcttctttaaatgtttg

SEQ ID NO: 7874 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
agcatttgtctaattattta

SEQ ID NO: 7875 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
caagtgggagatgaagatta

SEQ ID NO: 7876 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
aacaaaacaaaacaaaaatg

SEQ ID NO: 7877 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttttaatctgaagaggctgg

SEQ ID NO: 7878 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
tcttaagtaataataatgat

SEQ ID NO: 7879 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
accatggaaatgtaatagag

SEQ ID NO: 7880 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tagatataaccattatgtaa

SEQ ID NO: 7881 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
agaaaaaaattagtgaaaat

SEQ ID NO: 7882 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
attagtgaaaatcaagaata

SEQ ID NO: 7883 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
acaaagagaggacaagagag

SEQ ID NO: 7884 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
taatgagtctgctttttcag

SEQ ID NO: 7885 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
aatgttgcaactcaacatac

SEQ ID NO: 7886 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
gcaactcaacatactaagaa

SEQ ID NO: 7887 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tcagccattgactttaaatg

SEQ ID NO: 7888 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
atgaaagaaaaatgaacagg

SEQ ID NO: 7889 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aaataattcctcataaatgt

SEQ ID NO: 7890 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
ctcctgaagtgctttaacac

SEQ ID NO: 7891 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
taaatgggtgacagagttag

SEQ ID NO: 7892 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gaaaaaatgtccttggctac

SEQ ID NO: 7893 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aatactttctaacatgagct

SEQ ID NO: 7894 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
tcaatacataccttgactca

SEQ ID NO: 7895 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aagggactacatccatttgg

SEQ ID NO: 7896 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
agcaactggggaaaaagttt

SEQ ID NO: 7897 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aatcaattattaagaactag

SEQ ID NO: 7898 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gttaagaagaacttatgaca

SEQ ID NO: 7899 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tcatttcagcaagtgtatgg

SEQ ID NO: 7900 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
tggctttttggaaaatgctt

SEQ ID NO: 7901 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aaatgagctcaataataagg

SEQ ID NO: 7902 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tcagggtggggagagggggt

SEQ ID NO: 7903 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
agagggtcagccatacccag

SEQ ID NO: 7904 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
agaattaccatggggagcag

SEQ ID NO: 7905 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tcattactctttattacctg

SEQ ID NO: 7906 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
tattctgtccaagaagcgtg

SEQ ID NO: 7907 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
cttaatgtgacttttaaagc

SEQ ID NO: 7908 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gtctcaataagtctgattta

SEQ ID NO: 7909 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tattatcatgttaaacaaga

SEQ ID NO: 7910 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aactggcaataaaatgatca

SEQ ID NO: 7911 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aatgatcaaaagaataaatt

SEQ ID NO: 7912 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
cttctgtatactttctttgc

SEQ ID NO: 7913 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tttgccaagaattaataatt

SEQ ID NO: 7914 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tttatgtcaaaattttgtaa

SEQ ID NO: 7915 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ctactcaggaggctgaggca

SEQ ID NO: 7916 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tataaatacaaaacagagaa

SEQ ID NO: 7917 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
aaacagagaagaagaaacaa

SEQ ID NO: 7918 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
cttgagggtgatcaacaatt

SEQ ID NO: 7919 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
attttttgtgcagtaaaaat

SEQ ID NO: 7920 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
acaagtcaacgtggcagatt

SEQ ID NO: 7921 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ttttcactaatcagtataag

SEQ ID NO: 7922 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aataaaaaaaaagtacaagc

SEQ ID NO: 7923 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
atgccatcactttcaaaatt

SEQ ID NO: 7924 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tttcaaaattagagaaaaag

SEQ ID NO: 7925 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
catcacaaaataatttccac

SEQ ID NO: 7926 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
aaaattacaacacatattat

SEQ ID NO: 7927 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
acttttagttcaggattgct

SEQ ID NO: 7928 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
taatttgtgatatttttctt

SEQ ID NO: 7929 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
taaattattgtactatatta

SEQ ID NO: 7930 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
atattagcgtgtacttcaaa

SEQ ID NO: 7931 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tttaaaaataatgcaaaacc

SEQ ID NO: 7932 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
caaagaaatacccctttatt

SEQ ID NO: 7933 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
tgacaatccttccacatctg

SEQ ID NO: 7934 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
gattccagtaaagacctaag

SEQ ID NO: 7935 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ataatgtttttctgttaata

SEQ ID NO: 7936 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
catcatttttagacagcatt

SEQ ID NO: 7937 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
ttgacacagtcactattttc

SEQ ID NO: 7938 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gttgttctggaagaagataa

SEQ ID NO: 7939 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tttaaagatttatcagcaga

SEQ ID NO: 7940 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
atccggatctccaccaacaa

SEQ ID NO: 7941 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
caaagataaatagaagggaa

SEQ ID NO: 7942 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gaatatttgtagacaattta

SEQ ID NO: 7943 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
atttagaagaaaagacagac

SEQ ID NO: 7944 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
actatatgccaggctaataa

SEQ ID NO: 7945 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
cagaaagcatttaatcctcc

SEQ ID NO: 7946 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
gggcatatcactcatataat

SEQ ID NO: 7947 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
atatgtgaggtgtgtactta

SEQ ID NO: 7948 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
gcaatgtaattaggaaggtg

SEQ ID NO: 7949 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aaaatgttaagtgttgctcc

SEQ ID NO: 7950 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
tgctcccaagaaatatgctg

SEQ ID NO: 7951 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tcccaagatggtaacctttt

SEQ ID NO: 7952 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aattattttaaaagacataa

SEQ ID NO: 7953 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gacaatgatgacaactaaaa

SEQ ID NO: 7954 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
tatggagagcaattccagat

SEQ ID NO: 7955 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
tctggactcttcaagttctg

SEQ ID NO: 7956 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cacatatgtgggcatctttc

SEQ ID NO: 7957 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gagaactatgtttccttaac

SEQ ID NO: 7958 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
ataagatgagactattctgt

SEQ ID NO: 7959 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
acaatcctagaaccaagcaa

SEQ ID NO: 7960 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
atttgtaagattatatagtg

SEQ ID NO: 7961 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
tatggtctctgaattcttcc

SEQ ID NO: 7962 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
agatttatgttaattttatt

SEQ ID NO: 7963 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
aatcaattaatgtcttaaga

SEQ ID NO: 7964 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
agtgctgtgtatctaaaggg

SEQ ID NO: 7965 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
aaaggaacaattagtgaaat

SEQ ID NO: 7966 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gaggtgacctctcttcagct

SEQ ID NO: 7967 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aacaagtgtatttatttttg

SEQ ID NO: 7968 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
ctatgttggttccatgcagg

SEQ ID NO: 7969 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
ctgtgctatagtctgtcaaa

SEQ ID NO: 7970 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tggtgaaaaaactcttaaat

SEQ ID NO: 7971 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tgcaagcaaagtttgattcc

SEQ ID NO: 7972 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tatcctggaaactccaggaa

SEQ ID NO: 7973 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
caagtaatccaaatttcttc

SEQ ID NO: 7974 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
gagttagatgcctacaacac

SEQ ID NO: 7975 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tgaatcaaaggtgtgttcct

SEQ ID NO: 7976 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
ttgttctgctgcttcgcctt

SEQ ID NO: 7977 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
acgaatgctgagtggtgact

SEQ ID NO: 7978 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ggtggctctgtactgactta

SEQ ID NO: 7979 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
aaaacgaagcaattcagtga

SEQ ID NO: 7980 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
cttaagggatgaaacaattt

SEQ ID NO: 7981 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
tttttttactgtgtatatca

SEQ ID NO: 7982 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tttttaactagatttttagt

SEQ ID NO: 7983 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
ggttcatcttggggatttgt

SEQ ID NO: 7984 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
agatgaaggtttcagtgaaa

SEQ ID NO: 7985 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
gaaagagaacttccacataa

SEQ ID NO: 7986 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
atactattacctatactgtt

SEQ ID NO: 7987 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cctatactgtttaagaaaga

SEQ ID NO: 7988 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
cttctgaaaattagtttatt

SEQ ID NO: 7989 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
tcgttttctttacacaatga

SEQ ID NO: 7990 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
aaataaagctctattgtatt

SEQ ID NO: 7991 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
caattaactccatatcatca

SEQ ID NO: 7992 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
attattaaagcataatattg

SEQ ID NO: 7993 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aataaagatataaatgaaaa

SEQ ID NO: 7994 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aaaaaaagtcatcttacctc

SEQ ID NO: 7995 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
ctgcactgaatatttgtgca

SEQ ID NO: 7996 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ccttctcaaacatttacact

SEQ ID NO: 7997 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CGAGAAT
aggattaaggaggaaacttt

SEQ ID NO: 7998 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
agtatcaattctagctcagc

SEQ ID NO: 7999 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aattggttcctttttccaca

SEQ ID NO: 8000 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tttatacacaaaaattcatt

SEQ ID NO: 8001 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
gtttgcatttctacctctag

SEQ ID NO: 8002 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tcatgttatcaaaaatataa

SEQ ID NO: 8003 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
attaaacacattttcagtac

SEQ ID NO: 8004 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
cgctttctttgctttttaaa

SEQ ID NO: 8005 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
ctgttcctgttttagtttgc

SEQ ID NO: 8006 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
tgtgtgcatgtgtctttacc

SEQ ID NO: 8007 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
tgtgtgcatgtgtctttgta

SEQ ID NO: 8008 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
actatttcttcatagcctca

SEQ ID NO: 8009 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ctggccagggcaatcagaca

SEQ ID NO: 8010 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ccagggcaatcagacaagag

SEQ ID NO: 8011 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
caaatgacatgattctatat

SEQ ID NO: 8012 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
cccatttgcaattgctataa

SEQ ID NO: 8013 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
cattccatactcatggatag

SEQ ID NO: 8014 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
aaattaccattgacatcttc

SEQ ID NO: 8015 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ccattgacatcttcacagaa

SEQ ID NO: 8016 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
cagacatataggccaatgga

SEQ ID NO: 8017 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
aatggaatagaatagagacc

SEQ ID NO: 8018 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
gggaagctggctagccatat

SEQ ID NO: 8019 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
cccaaaccatgaaaacccta

SEQ ID NO: 8020 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taaagagcttctgcacagca

SEQ ID NO: 8021 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
tcagagtgaacaggcaaact

SEQ ID NO: 8022 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aacaggcaaactatagaatg

SEQ ID NO: 8023 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
atctgacaaaggtctaatat

SEQ ID NO: 8024 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taaatataaaataggccaaa

SEQ ID NO: 8025 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aaacagatctgcagctattc

SEQ ID NO: 8026 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
gaatcattgttatgtgtact

SEQ ID NO: 8027 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
agagatcaatgatataaatg

SEQ ID NO: 8028 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ttgggagcaattgatttggg

SEQ ID NO: 8029 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gatttgggagagaaaaactt

SEQ ID NO: 8030 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
gtccatgtgcaggagcagct

SEQ ID NO: 8031 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
gatctagagattaaatatgc

SEQ ID NO: 8032 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ttaaatatgcccagaaaaga

SEQ ID NO: 8033 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CGAGAAA
ctctggacactgactacaca

SEQ ID NO: 8034 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ggacaatattgaataaggat

SEQ ID NO: 8035 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
taggataataacatctacct

SEQ ID NO: 8036 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
acttagcttacatcctgcac

SEQ ID NO: 8037 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
cctatgagtcacatttaatt

SEQ ID NO: 8038 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
agaatgagtggaacttggga

SEQ ID NO: 8039 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgagtggaacttgggagtag

SEQ ID NO: 8040 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
actttgtgactcttcgtttt

SEQ ID NO: 8041 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
aagactggatttgctgtggg

SEQ ID NO: 8042 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
tgaaatatataaaaagcaat

SEQ ID NO: 8043 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tctttcagcctttagactaa

SEQ ID NO: 8044 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
aataaaaatattctgttgaa

SEQ ID NO: 8045 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
cagatagtgataaatgatct

SEQ ID NO: 8046 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gagatatttgggctggggga

SEQ ID NO: 8047 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
catgtcggaatttgcatatc

SEQ ID NO: 8048 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
ttaatgactgtgatacattc

SEQ ID NO: 8049 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tggaaagtgtgtatctaaag

SEQ ID NO: 8050 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
agacttttggagtaatcatg

SEQ ID NO: 8051 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ctgcatctgtaaaatacgta

SEQ ID NO: 8052 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
tttaataaggatggattact

SEQ ID NO: 8053 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ctactgtatttaacacagta

SEQ ID NO: 8054 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
aggtagctcactctaggttt

SEQ ID NO: 8055 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aatgggaaaaaattgaatgc

SEQ ID NO: 8056 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
gtgggatgattctgaaagat

SEQ ID NO: 8057 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctacttggcaggctgaggca

SEQ ID NO: 8058 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gaaatatcatttagcaataa

SEQ ID NO: 8059 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
gagtgggtaaatccctaggg

SEQ ID NO: 8060 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
ttagtggttgccaggggctg

SEQ ID NO: 8061 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
aaaattgatataacaaaaat

SEQ ID NO: 8062 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ttcaagattaatgtagcaaa

SEQ ID NO: 8063 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
aatggtaattctgcccttgc

SEQ ID NO: 8064 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aagggcaaataatgcaactc

SEQ ID NO: 8065 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
tctggcaaatgtagttctca

SEQ ID NO: 8066 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tctctattaaatgtcaaata

SEQ ID NO: 8067 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
atattagaaaaacaggagga

SEQ ID NO: 8068 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aaaatactttgctataggca

SEQ ID NO: 8069 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
ccaaatggctgaatgttggt

SEQ ID NO: 8070 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
gcattctcatcaaatcatct

SEQ ID NO: 8071 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctttatagccaaatttcttg

SEQ ID NO: 8072 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
accacttacccaaattttct

SEQ ID NO: 8073 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
cacccatccagttattgcag

SEQ ID NO: 8074 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ttcactaaaactacatttca

SEQ ID NO: 8075 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
actacatttcagaagaaaat

SEQ ID NO: 8076 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aaaaaatacatgaagcaatt

SEQ ID NO: 8077 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
taaaggctgtctgtgtacat

SEQ ID NO: 8078 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
atttttcttttaacaaaggt

SEQ ID NO: 8079 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
aaaccattcacagtataaac

SEQ ID NO: 8080 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
ctcagaaataggagcaagac

SEQ ID NO: 8081 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aataaaaggacagatcccag

SEQ ID NO: 8082 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
taattttacagcatataaat

SEQ ID NO: 8083 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tcaaatcatgtttgtaacaa

SEQ ID NO: 8084 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
attttatttatcacagtgag

SEQ ID NO: 8085 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aaaggacacatttggtaaaa

SEQ ID NO: 8086 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
tattactttttattatctaa

SEQ ID NO: 8087 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
agatacattccaggtgtcag

SEQ ID NO: 8088 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
cattcaattcatgctttatg

SEQ ID NO: 8089 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
gatgatctcatgtggtacct

SEQ ID NO: 8090 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aaggctacatttatttctct

SEQ ID NO: 8091 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aaataattcttttttatgat

SEQ ID NO: 8092 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
acacagtcaggatcatgaca

SEQ ID NO: 8093 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
tgtcttcaggcctgaaaatg

SEQ ID NO: 8094 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
aacaaaaaacacaagctttc

SEQ ID NO: 8095 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aaaaataggaacatattctc

SEQ ID NO: 8096 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
accttgtaataattttcaat

SEQ ID NO: 8097 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tcaataaagaaatggtttgc

SEQ ID NO: 8098 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gataatgattgtggaaaaca

SEQ ID NO: 8099 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaatttaattaaaattgcat

SEQ ID NO: 8100 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
attacttcttacctgggatt

SEQ ID NO: 8101 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
acaaattctgttaaatacct

SEQ ID NO: 8102 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
taaatacctgtagaattaaa

SEQ ID NO: 8103 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
tagaattaaatcagaattat

SEQ ID NO: 8104 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
ttcaaagtcattaacggaaa

SEQ ID NO: 8105 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
cagccagttccacgggtcac

SEQ ID NO: 8106 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
cattgggatactagatgtga

SEQ ID NO: 8107 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
ttaaactacaataggtctat

SEQ ID NO: 8108 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
aaaatattaaaatgtcaata

SEQ ID NO: 8109 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
tgtcaatatcagaaacactc

SEQ ID NO: 8110 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
gcagaggtacttgaaataac

SEQ ID NO: 8111 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
ataattataaaacatacacc

SEQ ID NO: 8112 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
catctgacaagttcattctt

SEQ ID NO: 8113 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
catagaggaggtaaagaaca

SEQ ID NO: 8114 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
ggtcataaatatgcagtttg

SEQ ID NO: 8115 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
agcatgctgaataaggtagc

SEQ ID NO: 8116 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gaaatgcttacaacttttcc

SEQ ID NO: 8117 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
ttcttcttagaggactgaaa

SEQ ID NO: 8118 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atgaaagtctgcaggaggaa

SEQ ID NO: 8119 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
ggaaaaagaaaggatgaaat

SEQ ID NO: 8120 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ctacatggcagtgttatatt

SEQ ID NO: 8121 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ccttccattacactgcattt

SEQ ID NO: 8122 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ctgcattttaagaaagccaa

SEQ ID NO: 8123 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
atatttttatcataaaacct

SEQ ID NO: 8124 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ttgaaggaacgtcagagttg

SEQ ID NO: 8125 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ccatagctttagtattcagt

SEQ ID NO: 8126 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
aagcaacctaaagcattggc

SEQ ID NO: 8127 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
ctaaagcattggcttagaaa

SEQ ID NO: 8128 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
tgtatgcggcagcgttccct

SEQ ID NO: 8129 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctaccctggaggctgaggtg

SEQ ID NO: 8130 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
aaagactaatacatgtatag

SEQ ID NO: 8131 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ttttgtattcaaggaacttc

SEQ ID NO: 8132 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
acttcctagaaaaatgaaaa

SEQ ID NO: 8133 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
caagatgtgacagatatcat

SEQ ID NO: 8134 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
tacagaaaaatataaagggg

SEQ ID NO: 8135 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tatacttgaaattttaataa

SEQ ID NO: 8136 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
aaatttcacaattgcttcaa

SEQ ID NO: 8137 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
cattccatgctcatgtgtag

SEQ ID NO: 8138 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
aatggaacagaacagagccc

SEQ ID NO: 8139 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tatctgatctttgacaaacc

SEQ ID NO: 8140 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
ggaaaactggctagccatat

SEQ ID NO: 8141 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ctaaaaccataaaaacccta

SEQ ID NO: 8142 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
atctgacaaaaggctaatat

SEQ ID NO: 8143 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aatgaactcaaacaaattta

SEQ ID NO: 8144 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
gctcatcatcactggccatc

SEQ ID NO: 8145 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gagataccatctcacaccag

SEQ ID NO: 8146 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
acaggtgctggagaggatgt

SEQ ID NO: 8147 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gattcctcagggatctagaa

SEQ ID NO: 8148 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ccaacaatgatagactggat

SEQ ID NO: 8149 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
tcattctcagtaaactatca

SEQ ID NO: 8150 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
ttttatacagaaggaagcca

SEQ ID NO: 8151 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taagaggcctggatggaaac

SEQ ID NO: 8152 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
agacttaactatttgcctgc

SEQ ID NO: 8153 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
actacaaaaggtaacatgtt

SEQ ID NO: 8154 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
ccttctaaccatctttatac

SEQ ID NO: 8155 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
cattaatgttctaataacat

SEQ ID NO: 8156 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tactctttggcccataggct

SEQ ID NO: 8157 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
caataggcagtgatattttg

SEQ ID NO: 8158 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tatttaattttctgaatagt

SEQ ID NO: 8159 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
gtagcacatttgatttcctt

SEQ ID NO: 8160 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
ttctagcttctgatttaaag

SEQ ID NO: 8161 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
attacaaagttgaaatattg

SEQ ID NO: 8162 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
gccacaaaccttcaacttgt

SEQ ID NO: 8163 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aagttaggataaaggttttt

SEQ ID NO: 8164 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
gattccatcttatgaaatgt

SEQ ID NO: 8165 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
tgtccagaataggcaaatcc

SEQ ID NO: 8166 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
aaactactatgaatatgcat

SEQ ID NO: 8167 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
aaaatatgtgaaaattgtcc

SEQ ID NO: 8168 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gtagacatactgtggctctt

SEQ ID NO: 8169 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
ctggagggtaccatctcttt

SEQ ID NO: 8170 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tctctttcaagaattatttg

SEQ ID NO: 8171 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
tgcacatgctcaacacagct

SEQ ID NO: 8172 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aaggcaaaatcgaaaaagat

SEQ ID NO: 8173 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gtcaaacctcactagtaatc

SEQ ID NO: 8174 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
gctgctcgggaggctgaggc

SEQ ID NO: 8175 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
atgtcatgtttttctatcca

SEQ ID NO: 8176 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
catgtttttctatccagaag

SEQ ID NO: 8177 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
ttactatgattgtatcttct

SEQ ID NO: 8178 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
ctcaccattaatctcatatt

SEQ ID NO: 8179 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
tacagtctagaacactcatc

SEQ ID NO: 8180 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
agaacactcatctgagaatg

SEQ ID NO: 8181 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tggcaaatatgtgatgtaga

SEQ ID NO: 8182 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
attatttattcaataatgtt

SEQ ID NO: 8183 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
cataaatattaatagattat

SEQ ID NO: 8184 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
aacagaccaaacttttaact

SEQ ID NO: 8185 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aagttaaagttagtattcct

SEQ ID NO: 8186 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
ttgtgaaacaaaaaatttca

SEQ ID NO: 8187 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
tacccaaaaggggcacttta

SEQ ID NO: 8188 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ccagtgagcattctcaggtg

SEQ ID NO: 8189 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
agatttttctatatatttta

SEQ ID NO: 8190 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
caaaataaaacttagaagat

SEQ ID NO: 8191 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
aaataataaacaaagtaatg

SEQ ID NO: 8192 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gaaagtttagagcattaaca

SEQ ID NO: 8193 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aaaataagataactaactaa

SEQ ID NO: 8194 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tcaatgctttcagtgtgatg

SEQ ID NO: 8195 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
acaaaatatatttctaggta

SEQ ID NO: 8196 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
aaaaagtacttctaaaacac

SEQ ID NO: 8197 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
ggcatgaacttgaacaactg

SEQ ID NO: 8198 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
cctggctaaagtttaagtaa

SEQ ID NO: 8199 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
taaaggtataaatccaaccc

SEQ ID NO: 8200 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
aatccaacccatagaattac

SEQ ID NO: 8201 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
aaacataactgcttggaatt

SEQ ID NO: 8202 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
gcttggaatttgagaatggg

SEQ ID NO: 8203 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aatttgagaatggggcagaa

SEQ ID NO: 8204 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ataaattcctcattttcaaa

SEQ ID NO: 8205 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ctcattttcaaattagaaag

SEQ ID NO: 8206 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tagagataaaaaggaaaata

SEQ ID NO: 8207 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ttatacctctctcttgagcc

SEQ ID NO: 8208 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
accaacaaacagctgcttaa

SEQ ID NO: 8209 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
ggttgtcaagagtgtatata

SEQ ID NO: 8210 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aggttttattattcaaaagg

SEQ ID NO: 8211 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
gaaaaaattcaattcaaaaa

SEQ ID NO: 8212 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aaaaaaaatctatcaattca

SEQ ID NO: 8213 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
agtctctattatgttcaatt

SEQ ID NO: 8214 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gaatgtgtaacaacattcaa

SEQ ID NO: 8215 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aagaaaggacaaagatacta

SEQ ID NO: 8216 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
attactttatgaaacactac

SEQ ID NO: 8217 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gtctaggacaagttcaggag

SEQ ID NO: 8218 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
taaacaatacaagagtatcc

SEQ ID NO: 8219 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
gctcaaaggattgggtcact

SEQ ID NO: 8220 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
cactgcagaatttcctttct

SEQ ID NO: 8221 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
ccaacacttggtttatcttc

SEQ ID NO: 8222 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
atcattaatgtaatctctga

SEQ ID NO: 8223 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
tgtaatctctgaacagaata

SEQ ID NO: 8224 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aatgatcccttccttcaagc

SEQ ID NO: 8225 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
atgaaagctatatttattta

SEQ ID NO: 8226 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
gataacttttgacatctctt

SEQ ID NO: 8227 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctactcaggaggctgaggca

SEQ ID NO: 8228 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gctttgaaaatgtcacttct

SEQ ID NO: 8229 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
taaagcattctcaaggcacc

SEQ ID NO: 8230 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
gtaccattgatactatgtga

SEQ ID NO: 8231 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
ttatagccttaatctaacca

SEQ ID NO: 8232 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
catcaaaaacaaggaaagcc

SEQ ID NO: 8233 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
agcctgggtgagatcttgaa

SEQ ID NO: 8234 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
agcaaaaggaaatcacagat

SEQ ID NO: 8235 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tttgatcaataggagatcca

SEQ ID NO: 8236 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gaatctgtgtgtattttctt

SEQ ID NO: 8237 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgtgaggtaacatagagata

SEQ ID NO: 8238 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ataagacttcccatgataaa

SEQ ID NO: 8239 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
ataggccttctcccatgaaa

SEQ ID NO: 8240 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
tctgttctatgtcttggcac

SEQ ID NO: 8241 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gaatagctctacagtttaga

SEQ ID NO: 8242 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ggtgcgaaacgattgaatct

SEQ ID NO: 8243 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
tccaagccaggattttgtgt

SEQ ID NO: 8244 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aagaataaatgctacacaac

SEQ ID NO: 8245 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
cttaccattgagagatcctt

SEQ ID NO: 8246 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
aaacttttcattttctgtct

SEQ ID NO: 8247 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
aggaggcagctgtaatatgg

SEQ ID NO: 8248 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ataatctttttataatctta

SEQ ID NO: 8249 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
cagcttcatttaactaatta

SEQ ID NO: 8250 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
acatggtttgtttcgtttgt

SEQ ID NO: 8251 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
ttttctgaaaactcaagttg

SEQ ID NO: 8252 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aaggaaaagatcttagacaa

SEQ ID NO: 8253 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
caaaaagaatggaaacacag

SEQ ID NO: 8254 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
atggaaacacagcaagaaat

SEQ ID NO: 8255 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
acagcaagaaatgaagaata

SEQ ID NO: 8256 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
taaaattttttctctgttgt

SEQ ID NO: 8257 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
gaccttttaataactgaaaa

SEQ ID NO: 8258 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
ataacttgctagcacaatta

SEQ ID NO: 8259 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tatgagagcaatgagaacac

SEQ ID NO: 8260 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ggcacctaacttggacttag

SEQ ID NO: 8261 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
tggtcagggaaggaagatga

SEQ ID NO: 8262 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ttactctcaacttttccaaa

SEQ ID NO: 8263 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
atacaactgggggaggaggt

SEQ ID NO: 8264 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
tcaattttgtaatggagaag

SEQ ID NO: 8265 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
aactggattattacacaatc

SEQ ID NO: 8266 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
gagatgagtgtcttcttctt

SEQ ID NO: 8267 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tataaaaagtcaaaaatgac

SEQ ID NO: 8268 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
tatccaatcttccttcttat

SEQ ID NO: 8269 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
tgggtctatgtacagctata

SEQ ID NO: 8270 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
atcaatatctttgcttaata

SEQ ID NO: 8271 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
acctcagaagtagtgattta

SEQ ID NO: 8272 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
acataatgcagtctgtaaat

SEQ ID NO: 8273 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ttcaaaaatatttttgtcct

SEQ ID NO: 8274 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
tcaagaaaatatggcaaatc

SEQ ID NO: 8275 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
atccaagaatatatttattt

SEQ ID NO: 8276 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
aagttattaaataataattg

SEQ ID NO: 8277 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
ggagttaccagagttagcaa

SEQ ID NO: 8278 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aagatatggaatgctatgag

SEQ ID NO: 8279 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
tgggttattttaaaagtcag

SEQ ID NO: 8280 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
gaatttgtgagaccttttct

SEQ ID NO: 8281 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
tttcggtgctttaaataaac

SEQ ID NO: 8282 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tcttcattagtagagtctga

SEQ ID NO: 8283 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
tgaacagaataaatgctgaa

SEQ ID NO: 8284 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
tgctgtttgagcagcgtcat

SEQ ID NO: 8285 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
cttgtaagcaagtcttttta

SEQ ID NO: 8286 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
gtagattttgtcctatagca

SEQ ID NO: 8287 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
agttattgactggtttattt

SEQ ID NO: 8288 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
cagaaacatggccactggaa

SEQ ID NO: 8289 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
gtcattatttcctaatgaat

SEQ ID NO: 8290 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
tgttcccttagccaaacctg

SEQ ID NO: 8291 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
tttaatcaccaattactgtc

SEQ ID NO: 8292 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aaaatcgattaagctgaggt

SEQ ID NO: 8293 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taagggactatttccttaac

SEQ ID NO: 8294 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ttccttaacaaagaaagtgg

SEQ ID NO: 8295 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
gtctagagggtaaatttaca

SEQ ID NO: 8296 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gatgaggcttaaagaacagg

SEQ ID NO: 8297 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
cccaagaggctaatggtttt

SEQ ID NO: 8298 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
taccttggaaacacaagggg

SEQ ID NO: 8299 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
agttaatgcatataaacact

SEQ ID NO: 8300 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cactcttcccaggatacaag

SEQ ID NO: 8301 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
cactgcattaagggggttcc

SEQ ID NO: 8302 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
aattatataaccatagtaat

SEQ ID NO: 8303 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
tttcgtgacctgacaattgg

SEQ ID NO: 8304 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
gaatacaaatcagttatttt

SEQ ID NO: 8305 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ctgttactccccaggccagt

SEQ ID NO: 8306 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
atgttttaaaactttaaaat

SEQ ID NO: 8307 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tttattcagcagacttgagt

SEQ ID NO: 8308 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tctctgatatataatgtatc

SEQ ID NO: 8309 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
ggggaaagacatgcatgttc

SEQ ID NO: 8310 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
tgcatgttcttagaattttg

SEQ ID NO: 8311 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
aaatagatgagaaccttagt

SEQ ID NO: 8312 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
gaagttacacgggtagtctg

SEQ ID NO: 8313 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
cagtattacagcttgaaaac

SEQ ID NO: 8314 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
acagcttgaaaacaaagaaa

SEQ ID NO: 8315 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
cctcaaataacacatcttgg

SEQ ID NO: 8316 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
acatcttgggaagaatgtac

SEQ ID NO: 8317 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
ttttataatttataattatc

SEQ ID NO: 8318 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ctaagttttgtctatttttt

SEQ ID NO: 8319 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
cttcatgtacaaatatatgc

SEQ ID NO: 8320 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
taattgaccttaccttttta

SEQ ID NO: 8321 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
gcaaatggaaatttcacatt

SEQ ID NO: 8322 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
ttctcccactttataccgtc

SEQ ID NO: 8323 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
taatttgatagaagacaatg

SEQ ID NO: 8324 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
ttttgctatgacacagtaca

SEQ ID NO: 8325 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
gtcatttcattcaggaaata

SEQ ID NO: 8326 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
aaaggtttcggttttaacct

SEQ ID NO: 8327 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
attgttttgtaagcatactt

SEQ ID NO: 8328 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
attatattataccttatatt

SEQ ID NO: 8329 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aattatgatgccctataaat

SEQ ID NO: 8330 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
tgcatttactttaaaatcgt

SEQ ID NO: 8331 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aagattaaaccattagagtc

SEQ ID NO: 8332 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gaaaattttctacctcacgt

SEQ ID NO: 8333 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
aaaattgaaacttttaaaga

SEQ ID NO: 8334 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
atagatttgtgataacctat

SEQ ID NO: 8335 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
taatcaatgttttatttcaa

SEQ ID NO: 8336 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ctagattacttttctgggaa

SEQ ID NO: 8337 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
taggatggtattaagaacta

SEQ ID NO: 8338 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
agtgagattgtgtttcaaaa

SEQ ID NO: 8339 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gattgtgtttcaaaaaaaga

SEQ ID NO: 8340 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgtttcaaaaaaagaaaaga

SEQ ID NO: 8341 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
caaaaaaagaaaagaaaaga

SEQ ID NO: 8342 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaagaaaagaaaagaaaaga

SEQ ID NO: 8343 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
agataacagattaggatcat

SEQ ID NO: 8344 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aagtacatatgcctttctat

SEQ ID NO: 8345 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aactaaactagcacagacaa

SEQ ID NO: 8346 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
tattgatcacatcacattac

SEQ ID NO: 8347 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
gtcaacatgaatatgaaata

SEQ ID NO: 8348 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tatgaaatatgagaaaccac

SEQ ID NO: 8349 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
cttgtaatttgtacattcgc

SEQ ID NO: 8350 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
gtccttcaagtcatccgcca

SEQ ID NO: 8351 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aagagtactgggcttggtca

SEQ ID NO: 8352 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aatcctttgtgcaaacaggg

SEQ ID NO: 8353 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
atcatagctgtatgattaga

SEQ ID NO: 8354 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
atgtgaagcagcagtgtaag

SEQ ID NO: 8355 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
actacatttcagacctcatg

SEQ ID NO: 8356 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
gtggtactcaatgttctttc

SEQ ID NO: 8357 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tgaattgtggtgtgcataac

SEQ ID NO: 8358 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
gattgatataaaactaagtt

SEQ ID NO: 8359 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aacaaaaacagatataattg

SEQ ID NO: 8360 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
atctttttattttcatccca

SEQ ID NO: 8361 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
atagaagtttatcatgttag

SEQ ID NO: 8362 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
cttgaaacaacaaagatgga

SEQ ID NO: 8363 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
tcgtgaaaagagtaaacaag

SEQ ID NO: 8364 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
aaacaactcaatactgtcca

SEQ ID NO: 8365 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
actaaatatggagcaggtgc

SEQ ID NO: 8366 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
gaaaagccaggagaggaaca

SEQ ID NO: 8367 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
catcagaaagacacaaaaat

SEQ ID NO: 8368 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
agacatttgcacaatagttt

SEQ ID NO: 8369 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
ttacagtgatgctgaactaa

SEQ ID NO: 8370 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
taggacatcaagtaattatt

SEQ ID NO: 8371 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
gggttcatgaatcattgctc

SEQ ID NO: 8372 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
cccaggggataggttttcat

SEQ ID NO: 8373 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
agccttgagttctgtgctat

SEQ ID NO: 8374 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
aggcatttaaagttcatgcc

SEQ ID NO: 8375 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
tgtacatttttcctacaaac

SEQ ID NO: 8376 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
atttttcctacaaactaaga

SEQ ID NO: 8377 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
accatttactccctgggaac

SEQ ID NO: 8378 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
actctcattttgtcttatcc

SEQ ID NO: 8379 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aagaccagcctgaccaacat

SEQ ID NO: 8380 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctcctcggaaggctgaggca

SEQ ID NO: 8381 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
cttactttaaaaagaaggaa

SEQ ID NO: 8382 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aaagaaggaaacagaaaaag

SEQ ID NO: 8383 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
caaaatgtaaggaaccaatg

SEQ ID NO: 8384 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gtaaggaaccaatgaaagaa

SEQ ID NO: 8385 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ttaggagtatttcaatggtc

SEQ ID NO: 8386 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
agtactgttaattctgaaaa

SEQ ID NO: 8387 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gagaccagtctgaccaacat

SEQ ID NO: 8388 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ctactcaggaggctgaggca

SEQ ID NO: 8389 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
ttatgtaaggagagagatta

SEQ ID NO: 8390 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
taggtatccctatatgtgcc

SEQ ID NO: 8391 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
tctctgctgattttaggaat

SEQ ID NO: 8392 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
attttaggaattcagaaatt

SEQ ID NO: 8393 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
agacacattgaattgagctc

SEQ ID NO: 8394 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
cttagaattttgtctgtaaa

SEQ ID NO: 8395 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aagatggttataactaagag

SEQ ID NO: 8396 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
cgacacaaaggcttccaagg

SEQ ID NO: 8397 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
aagcatgaaaagcctaaaaa

SEQ ID NO: 8398 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
cacacatcagggtggtgaaa

SEQ ID NO: 8399 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
agggtggtgaaatgagaaag

SEQ ID NO: 8400 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ttcagagaagcagagctggt

SEQ ID NO: 8401 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
atcagtctttgctatggaca

SEQ ID NO: 8402 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
atcatcaacctgataccatc

SEQ ID NO: 8403 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
cagtaaaaaatgtaagtgag

SEQ ID NO: 8404 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
cttcattctatggcgtttct

SEQ ID NO: 8405 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gccctaaacccgtaaaatgg

SEQ ID NO: 8406 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
gccctacttttaacagcctg

SEQ ID NO: 8407 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
tgcattcctttgctacaaga

SEQ ID NO: 8408 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gactgcagtaagactgaaac

SEQ ID NO: 8409 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
cttacattctgtactgaagt

SEQ ID NO: 8410 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tgtttccaaaaaaaaaaaaa

SEQ ID NO: 8411 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tctacagctccccactatgt

SEQ ID NO: 8412 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
taactatcattgattttaca

SEQ ID NO: 8413 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
cgatcaagtatttaattgtt

SEQ ID NO: 8414 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
aatccaagacacatttattt

SEQ ID NO: 8415 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aatatagcaaattttcattg

SEQ ID NO: 8416 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
aattttcattgggagaaaat

SEQ ID NO: 8417 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aatttagaaaactgaaaagc

SEQ ID NO: 8418 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
taaatgaaattaacctattc

SEQ ID NO: 8419 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
tacatactgacaaaatgttt

SEQ ID NO: 8420 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
aaactggttttcaaaaatga

SEQ ID NO: 8421 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
tatttctgggaaacataggc

SEQ ID NO: 8422 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
gcattcttatatttattttt

SEQ ID NO: 8423 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
accctaactctgctgatctt

SEQ ID NO: 8424 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ctcctgtgttttatattatc

SEQ ID NO: 8425 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atattatccatctcaggtga

SEQ ID NO: 8426 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ccatctcaggtgaaaagaaa

SEQ ID NO: 8427 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
gtatgccaagtataatatca

SEQ ID NO: 8428 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
cttaaaataattattatttc

SEQ ID NO: 8429 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
tatagtattcctcaagttta

SEQ ID NO: 8430 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aagaccagcctgaccaacat

SEQ ID NO: 8431 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ctgtctcaaaaaaaaaaaaa

SEQ ID NO: 8432 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaaaaaaaagaaaaaaaaaa

SEQ ID NO: 8433 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
tacagcatgtataaaggaag

SEQ ID NO: 8434 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
acccttatttaaataattag

SEQ ID NO: 8435 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
caaaacatcaacatgattta

SEQ ID NO: 8436 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aaattccccataaatgaaag

SEQ ID NO: 8437 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
ctgtcttataaagttatcat

SEQ ID NO: 8438 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ttataaagttatcatgtaga

SEQ ID NO: 8439 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CGAGAAT
aaagctaatgttcttaggaa

SEQ ID NO: 8440 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
atatatttgcttactttata

SEQ ID NO: 8441 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
cttcttagggagctttcaac

SEQ ID NO: 8442 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
attggaatatcatgggaacc

SEQ ID NO: 8443 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aataataaaatgatcgaaag

SEQ ID NO: 8444 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
tgatgaccctctaggactga

SEQ ID NO: 8445 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tccagaacttaatgctaaag

SEQ ID NO: 8446 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAT
tttttgatgaagacattgtt

SEQ ID NO: 8447 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
ttactttctgccattttggg

SEQ ID NO: 8448 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ataaataggattggagtcat

SEQ ID NO: 8449 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
acaggatcacaaatgaatag

SEQ ID NO: 8450 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
gcctaaacatttgctttatc

SEQ ID NO: 8451 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
ccacaaggattgtctaaaaa

SEQ ID NO: 8452 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
taaatctaagattctaaata

SEQ ID NO: 8453 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tcattgatctacttgaccgt

SEQ ID NO: 8454 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
tgatttaatcatatctagga

SEQ ID NO: 8455 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaagttttaatactggtata

SEQ ID NO: 8456 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
gagttagaactgtaaatttc

SEQ ID NO: 8457 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaccaaaagcacggtcaaca

SEQ ID NO: 8458 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ttgtgcatcaaagaacacta

SEQ ID NO: 8459 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
aaaaggcaatccatatgatg

SEQ ID NO: 8460 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atttgaaaagacatttttcc

SEQ ID NO: 8461 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgtttaaaaaaaaaaaagga

SEQ ID NO: 8462 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
agaaacattgacaagggtgt

SEQ ID NO: 8463 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
gtggttcctcaaaaaattaa

SEQ ID NO: 8464 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
gttccacttacatgaggtac

SEQ ID NO: 8465 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
cctagaatagtcacattcat

SEQ ID NO: 8466 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAT
tagtcacattcatagagaaa

SEQ ID NO: 8467 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAA
cgtgttttgagatccgtaag

SEQ ID NO: 8468 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
tatgcagtaccactatttca

SEQ ID NO: 8469 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
ccccaaatagtaagaggttc

SEQ ID NO: 8470 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
ccaatccattacagacagga

SEQ ID NO: 8471 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gacaaaaacattatttttgt

SEQ ID NO: 8472 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
acattatttttgtatagaaa

SEQ ID NO: 8473 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
tggttttatgttacccatgt

SEQ ID NO: 8474 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAA
gttagtaatccctacaaaat

SEQ ID NO: 8475 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
gcaattgctgttttttgtga

SEQ ID NO: 8476 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gaagaaggaagagagggaaa

SEQ ID NO: 8477 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
aatatttgtactcctccaat

SEQ ID NO: 8478 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAT
ttccctgtttcttctccatt

SEQ ID NO: 8479 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
cctcaggaattggtgtccaa

SEQ ID NO: 8480 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
ttaagggttaaacatatttg

SEQ ID NO: 8481 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tataagatttctttcctata

SEQ ID NO: 8482 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctacttgggaggctgaggca

SEQ ID NO: 8483 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
ctactcgggaggctgaggca

SEQ ID NO: 8484 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
ctcggtctcaaaaaaaaaaa

SEQ ID NO: 8485 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
atttacaggaaagcaatatt

SEQ ID NO: 8486 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
caagtttgtaaatggggtaa

SEQ ID NO: 8487 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tacactgtctattagacttg

SEQ ID NO: 8488 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
atataaattttaattttttt

SEQ ID NO: 8489 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAT
gctactcggaggctgaggca

SEQ ID NO: 8490 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aaataaaaaataaaaaaaaa

SEQ ID NO: 8491 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gagagaagaaggaaaaaaaa

SEQ ID NO: 8492 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TCAGAAA
attgtattttgataaatgat

SEQ ID NO: 8493 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aaaatccaaggagacatttt

SEQ ID NO: 8494 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gatagttcatctcctgtgtt

SEQ ID NO: 8495 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
ctctatagaactaaaaagat

SEQ ID NO: 8496 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
gggtaagtgataccttcaat

SEQ ID NO: 8497 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAT
caatgaagaaatttcatttt

SEQ ID NO: 8498 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
agatgtcataatacttctgt

SEQ ID NO: 8499 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
tgcctctctgaaccttcctt

SEQ ID NO: 8500 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
aagcatctatgtttatttta

SEQ ID NO: 8501 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
atttgtggtcactgcctttc

SEQ ID NO: 8502 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
atcacctacactgataaaag

SEQ ID NO: 8503 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
aaatgcttgacaaataaaaa

SEQ ID NO: 8504 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ggttaatatgctttattctg

SEQ ID NO: 8505 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
atgctgtaacaagcagtatg

SEQ ID NO: 8506 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
gcaggagcaccttaatgaga

SEQ ID NO: 8507 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAT
aggatggtattgctttgtat

SEQ ID NO: 8508 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
tatagagaatgaattgcagg

SEQ ID NO: 8509 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
aatttggtggccgtgtagat

SEQ ID NO: 8510 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
catctgagacgtatgatgaa

SEQ ID NO: 8511 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
cagataatgaagatgggagg

SEQ ID NO: 8512 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
aattattatcattatgacat

SEQ ID NO: 8513 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ttacaagatcatgacttgtc

SEQ ID NO: 8514 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
cttttgcataactaatagga

SEQ ID NO: 8515 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tctacttttttccttgccac

SEQ ID NO: 8516 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
aaaaaatctcaccataatta

SEQ ID NO: 8517 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ttaaatagtggaaaaaatct

SEQ ID NO: 8518 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aatatatttaaataacaagg

SEQ ID NO: 8519 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
tttaaataacaaggaaagaa

SEQ ID NO: 8520 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
aataacaaggaaagaaagag

SEQ ID NO: 8521 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tttatcttgtctacagggaa

SEQ ID NO: 8522 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
ttgtctacagggaagaagaa

SEQ ID NO: 8523 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAT
tacagggaagaagaaataga

SEQ ID NO: 8524 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aataaataaataatctgcgc

SEQ ID NO: 8525 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAA
taacaactctgctagcgtaa

SEQ ID NO: 8526 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
ccctccccacagaagcagca

SEQ ID NO: 8527 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
catccccacccagtgcacct

SEQ ID NO: 8528 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GCAGAAT
ctttcctcccttcctgctca

SEQ ID NO: 8529 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GGAGAAA
gtgtggcttggtggggagct

SEQ ID NO: 8530 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ttttctttcgaagatgcagt

SEQ ID NO: 8531 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
agaggaggtcctaggtgggg

SEQ ID NO: 8532 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
ggttgaattatctttctcaa

SEQ ID NO: 8533 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
acaggaaatttccaccaagg

SEQ ID NO: 8534 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CAAGAAT
acataaccgctactcccaca

SEQ ID NO: 8535 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
cccattatcaacattcccca

SEQ ID NO: 8536 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ACAGAAT
tatcctatagttgcaataat

SEQ ID NO: 8537 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
tgagagtatgtttagttttt

SEQ ID NO: 8538 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
ttatgcctttgctgttatat

SEQ ID NO: 8539 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAA
ttcttgctcttttggcagcc

SEQ ID NO: 8540 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
aattttatcttggtttaaac

SEQ ID NO: 8541 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
actgaccttccgtaacttag

SEQ ID NO: 8542 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAT
ctaacatcatacaatccata

SEQ ID NO: 8543 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAT
aatccataccagaataggaa

SEQ ID NO: 8544 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TGAGAAA
aagaattttatttcccttag

SEQ ID NO: 8545 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TTAGAAA
ttttctctaattaaatagga

SEQ ID NO: 8546 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: TAAGAAA
tgcacggcaatattacaaag

SEQ ID NO: 8547 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
attattctgttgtgaaaata

SEQ ID NO: 8548 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
gaacttcaaattataactaa

SEQ ID NO: 8549 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAT
caaattataactaaaaagaa

SEQ ID NO: 8550 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tgatgcttaatgaaacaact

SEQ ID NO: 8551 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
cgtggtctggatttttttgg

SEQ ID NO: 8552 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAA
tttggccagaaaactgatgt

SEQ ID NO: 8553 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GAAGAAT
ttaattgattacttattcct

SEQ ID NO: 8554 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aagacagtgatccctagaga

SEQ ID NO: 8555 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AAAGAAA
cagtgatccctagagaagag

SEQ ID NO: 8556 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CCAGAAA
gaagatggaaacatgaagag

SEQ ID NO: 8557 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CTAGAAT
agtttgataggctgagggag

SEQ ID NO: 8558 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: GTAGAAA
agagagtataccagagatct

SEQ ID NO: 8559 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: AGAGAAA
aaacaaaaataccctaagcc

SEQ ID NO: 8560 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: CGAGAAA
ctaacaatggagatatgtac

SEQ ID NO: 8561 - DNA, 20 bp, synthetic construct
  source 1..20: mol_type = other DNA; note = Description of Artificial Sequence: Synthetic oligonucleotide; note = Target: SCN9A; (+) strand; PAM type: NNAGAAW; PAM sequence: ATAGAAA
gtgtctaatcatacctaaac

SEQ ID NO: 8562 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tgtctataaaagtatgaatc

SEQ ID NO: 8563 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ctgacaatgtctataaaagt

SEQ ID NO: 8564 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
agtggctgtcctgtgcatgg

SEQ ID NO: 8565 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
gagctggataattctttgtt

SEQ ID NO: 8566 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tggcaatcttgatatttgag

SEQ ID NO: 8567 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gacatttatttctctaaggc

SEQ ID NO: 8568 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tctttcacatggtaagttga

SEQ ID NO: 8569 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
catgtctttcacatggtaag

SEQ ID NO: 8570 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
aatagttttctttctgtttg

SEQ ID NO: 8571 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
acatttccctgcttaaaatt

SEQ ID NO: 8572 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ttctcagtacagtagccaga

SEQ ID NO: 8573 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tctattctcagtacagtagc

SEQ ID NO: 8574 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tgtggattttggtattctca

SEQ ID NO: 8575 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tataagagatttgagcatct

SEQ ID NO: 8576 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ggtaattttaaactatatag

SEQ ID NO: 8577 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tccatatgctgagtactaca

SEQ ID NO: 8578 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
aaacttgaattttccatatg

SEQ ID NO: 8579 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaagccccaaaaggcaaaac

SEQ ID NO: 8580 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
atctgtggattcaaccaatt

SEQ ID NO: 8581 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
atatccatggtttctgatct

SEQ ID NO: 8582 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gtctctcttcttttttctat

SEQ ID NO: 8583 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tctaacagttcccgaggctg

SEQ ID NO: 8584 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tcataataatataccataga

SEQ ID NO: 8585 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cttaaagcaatagcaggagc

SEQ ID NO: 8586 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ttgcagaagacatgagactc

SEQ ID NO: 8587 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tgcattatatatttcactct

SEQ ID NO: 8588 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
ctatgtcaatacatttaagg

SEQ ID NO: 8589 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gcctttaaaatgtaggccaa

SEQ ID NO: 8590 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gtaattttctcaaagtcaaa

SEQ ID NO: 8591 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
atttgtgatcatttgttaca

SEQ ID NO: 8592 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
gaacagaaaaaataagtgga

SEQ ID NO: 8593 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
taacagaacagaaaaaataa

SEQ ID NO: 8594 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
atatcttgctcatataagaa

SEQ ID NO: 8595 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ctgctcatttttatatgaga

SEQ ID NO: 8596 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
taaatatgtgagaacataat

SEQ ID NO: 8597 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aattatatccagtgaatatt

SEQ ID NO: 8598 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ttatgggaaaattatatcca

SEQ ID NO: 8599 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttttagtgatgtgtaaaatt

SEQ ID NO: 8600 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ctgcatcattgcactttagc

SEQ ID NO: 8601 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atgcacacaggaaatgaaac

SEQ ID NO: 8602 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
tacatactagctagagcaga

SEQ ID NO: 8603 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
aacccaagcaaaatgagctg

SEQ ID NO: 8604 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gcaaaatagaattataatca

SEQ ID NO: 8605 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gcaatagccactctgcaaaa

SEQ ID NO: 8606 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gtggttcttaccatttttag

SEQ ID NO: 8607 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tttagctacttttgagattt

SEQ ID NO: 8608 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
agtataactatagtgcccaa

SEQ ID NO: 8609 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
caatattttctctattttat

SEQ ID NO: 8610 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
acaggaacaatgcactcttc

SEQ ID NO: 8611 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tgaaaatttatattagtagt

SEQ ID NO: 8612 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tcattatgtggttgtaatga

SEQ ID NO: 8613 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
cttatctataaaatgaggag

SEQ ID NO: 8614 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gccatgaccctatgagtttg

SEQ ID NO: 8615 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
cccagttaagccatgaccct

SEQ ID NO: 8616 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
catacataatggctaagagc

SEQ ID NO: 8617 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
attctacccttacaaccaca

SEQ ID NO: 8618 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ctgtatgacacagaagtagc

SEQ ID NO: 8619 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aaagacaaggacaaagaatc

SEQ ID NO: 8620 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gggaaacaaagacaaggaca

SEQ ID NO: 8621 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
accataggtgggtaaagtca

SEQ ID NO: 8622 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
ttcagttagaataaccatag

SEQ ID NO: 8623 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cacgtattttctgtttcagt

SEQ ID NO: 8624 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gacacattgtaatataatct

SEQ ID NO: 8625 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tctatgaatgctcaaaatgt

SEQ ID NO: 8626 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tttacaaatttcatagatct

SEQ ID NO: 8627 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
atatcataaagctgtttaca

SEQ ID NO: 8628 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atgaaaataaataaatagcc

SEQ ID NO: 8629 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tcttcttgaggaaaacaatc

SEQ ID NO: 8630 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
aggatggccagggaattggc

SEQ ID NO: 8631 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
caactaaattaggatggcca

SEQ ID NO: 8632 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
gaaagaagggccaactaaat

SEQ ID NO: 8633 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gttttgatagctttattaaa

SEQ ID NO: 8634 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aaatacttagcatgatttta

SEQ ID NO: 8635 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ttacctagtttgcaaaagat

SEQ ID NO: 8636 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGGAT
caggtttgaacacaaatctt

SEQ ID NO: 8637 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
gtcatgacctgccaacatgc

SEQ ID NO: 8638 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
tatttaaatttttgtagata

SEQ ID NO: 8639 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tctcgctctgtcacccaggc

SEQ ID NO: 8640 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttacactgaagaacttaact

SEQ ID NO: 8641 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tatatatttacgtttgtttc

SEQ ID NO: 8642 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ctcacaaatataactgcatt

SEQ ID NO: 8643 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aatttaacatcaccttaaat

SEQ ID NO: 8644 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atttttaaatacattcaatt

SEQ ID NO: 8645 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aaagaatgagatcagaagtc

SEQ ID NO: 8646 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gaaacaaagatttatggtta

SEQ ID NO: 8647 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tctggcaatttaaaaagaaa

SEQ ID NO: 8648 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
caaaaattgagctacacagg

SEQ ID NO: 8649 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttttttcgtgagtttatttc

SEQ ID NO: 8650 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
taaccataatgctttttttc

SEQ ID NO: 8651 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
aattatggaagtaatctttt

SEQ ID NO: 8652 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gaataaaaaagcattgaaat

SEQ ID NO: 8653 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tacacagatatgtgtttagt

SEQ ID NO: 8654 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttcatatccctttttgttca

SEQ ID NO: 8655 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
acaaggataagacttacctt

SEQ ID NO: 8656 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
atcttgactcacatgccaac

SEQ ID NO: 8657 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tatgtgcctataaaatgcca

SEQ ID NO: 8658 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agaagtaatggacattagtt

SEQ ID NO: 8659 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tctgccttgtcatcttttca

SEQ ID NO: 8660 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gaatcgtaagagaactctgt

SEQ ID NO: 8661 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttttgcactgatgattcttt

SEQ ID NO: 8662 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ccacactaaaacggaaacaa

SEQ ID NO: 8663 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ttttgggtgagagtggggag

SEQ ID NO: 8664 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ttacaaagcgtgttttgggt

SEQ ID NO: 8665 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ttgcttttacaaagcgtgtt

SEQ ID NO: 8666 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGAT
ctgcccatggttagtggtga

SEQ ID NO: 8667 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
acaaagtccagctcattgcc

SEQ ID NO: 8668 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tctctgattttgcagctgcc

SEQ ID NO: 8669 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tcccgatgcgacccagttta

SEQ ID NO: 8670 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
aaagtactgaacctctgagt

SEQ ID NO: 8671 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
ctgaagaaagtactgaacct

SEQ ID NO: 8672 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgtacattgcagtcatactg

SEQ ID NO: 8673 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gactgtggtaacccatctgt

SEQ ID NO: 8674 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tacaacctctgctggctggg

SEQ ID NO: 8675 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
aaattacaacctctgctggc

SEQ ID NO: 8676 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gcctatgttaaaaaggaaga

SEQ ID NO: 8677 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgttcatctacgccatctt

SEQ ID NO: 8678 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
cgtctagtcaaaggagcaaa

SEQ ID NO: 8679 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAAT
atccgtcttgccaggattgg

SEQ ID NO: 8680 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
ttccgagtgatccgtcttgc

SEQ ID NO: 8681 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
tttgtgtcccctaccctgtt

SEQ ID NO: 8682 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
agttgacagataaaactgtt

SEQ ID NO: 8683 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ctgtcttgaattcataagaa

SEQ ID NO: 8684 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaaaaaaaaaaaaaactgtc

SEQ ID NO: 8685 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tactcgggaggctgaggcag

SEQ ID NO: 8686 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGGAT
actttgggaggccgaggcgg

SEQ ID NO: 8687 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
taatgttagtcatttctctt

SEQ ID NO: 8688 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
gtattgcttgaattttctat

SEQ ID NO: 8689 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttagcatttaacggtattgc

SEQ ID NO: 8690 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
acaaaaaaagcttatataac

SEQ ID NO: 8691 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGAT
gctggagaatcatttgatcc

SEQ ID NO: 8692 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tactctggaggctgaggctg

SEQ ID NO: 8693 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tatgcatactatatgctata

SEQ ID NO: 8694 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
cacatactatgtatatagta

SEQ ID NO: 8695 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aatggtagcactcaatactg

SEQ ID NO: 8696 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttggtaaaaaactataaag

SEQ ID NO: 8697 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
aacaaaacacaaggaaaatt

SEQ ID NO: 8698 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
agaagttaaaaacaaccaat

SEQ ID NO: 8699 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aattgttcttataaattaat

SEQ ID NO: 8700 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
cataacagttaaggccgaga

SEQ ID NO: 8701 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttactgtgtgaaaagatcac

SEQ ID NO: 8702 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
aaaagctcagtgggtttgaa

SEQ ID NO: 8703 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
tgttcaaatataaaagctca

SEQ ID NO: 8704 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
aaattcatctggaagaaaat

SEQ ID NO: 8705 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
aatgagtctttttatgtagt

SEQ ID NO: 8706 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
taaattcaaggaaaatatca

SEQ ID NO: 8707 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aagaaagctaaaataattga

SEQ ID NO: 8708 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
gagacttctgaagaaaactt

SEQ ID NO: 8709 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
caactaaaaataaattcaat

SEQ ID NO: 8710 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aacttgttcatatattgaaa

SEQ ID NO: 8711 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
aggtacatatataaaaacaa

SEQ ID NO: 8712 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tattaagtcaggaaaaaaaa

SEQ ID NO: 8713 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaatgtattaaaatttaggt

SEQ ID NO: 8714 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
taaaattgagtgccacataa

SEQ ID NO: 8715 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
catgacttagaatcataaaa

SEQ ID NO: 8716 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aggttcaaggttgcatgact

SEQ ID NO: 8717 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tttaggattgtatttctttt

SEQ ID NO: 8718 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
acatatcttgcaaagtattt

SEQ ID NO: 8719 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
cagccatggtgttcatgtct

SEQ ID NO: 8720 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tgaatttgtgaaaattcttc

SEQ ID NO: 8721 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tattaatagccagaatatct

SEQ ID NO: 8722 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ttaatgataatattaatagc

SEQ ID NO: 8723 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tgtgtcttggaaaaccaatg

SEQ ID NO: 8724 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tctctcatactacagtgttt

SEQ ID NO: 8725 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tgagtaagtcagtacaatga

SEQ ID NO: 8726 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tcttgaacacaaatttactc

SEQ ID NO: 8727 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tatgctcaaggaagtatatg

SEQ ID NO: 8728 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tatttttcagattttatttt

SEQ ID NO: 8729 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tgattatctccattgtaggt

SEQ ID NO: 8730 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
actactacttcactgtagga

SEQ ID NO: 8731 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
cagacactactacttcactg

SEQ ID NO: 8732 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttttataatccttttcactg

SEQ ID NO: 8733 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
catatgactgaagttttata

SEQ ID NO: 8734 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
taaccatgatggtagaaaag

SEQ ID NO: 8735 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ttctttgcagaacaaaatcc

SEQ ID NO: 8736 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ttaatgcacatctttaattt

SEQ ID NO: 8737 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
caaaagccaattcctcgacc

SEQ ID NO: 8738 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
ctataatgcaatgaaaaagc

SEQ ID NO: 8739 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aacactgattagcacaccaa

SEQ ID NO: 8740 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tctttgtagtaattgtgaat

SEQ ID NO: 8741 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ttattctctttgtagtaatt

SEQ ID NO: 8742 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tccttcacatcccttgtaag

SEQ ID NO: 8743 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
agtcttcctatccatgagca

SEQ ID NO: 8744 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gtaatgccattttcatgata

SEQ ID NO: 8745 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gtagcttgatggggatagca

SEQ ID NO: 8746 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
aaagtcagtggtagcttgat

SEQ ID NO: 8747 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ccagctttgttctttttgct

SEQ ID NO: 8748 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ttgtttttgtgaggtttgtc

SEQ ID NO: 8749 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ttttgtacaaggtgtaagga

SEQ ID NO: 8750 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
atttaagtctttaatccatc

SEQ ID NO: 8751 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
atattgcctagagtttcttc

SEQ ID NO: 8752 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
atgtcctgaatgatattgcc

SEQ ID NO: 8753 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tctttgcccatgcctatgtc

SEQ ID NO: 8754 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
gatattagcccttttgtcag

SEQ ID NO: 8755 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
gtttaagttctttgtagatt

SEQ ID NO: 8756 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
atcctttgcccactttttga

SEQ ID NO: 8757 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttctagttttagattcttg

SEQ ID NO: 8758 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tatacccagtaatgagattg

SEQ ID NO: 8759 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gtagcatgatttacaatccc

SEQ ID NO: 8760 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ggttccaagtctttgctatt

SEQ ID NO: 8761 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
agtctattattgatggacat

SEQ ID NO: 8762 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
cgtccttgtgatattttgct

SEQ ID NO: 8763 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cacttatgagtgagaacatg

SEQ ID NO: 8764 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tcattgttcaactcccactt

SEQ ID NO: 8765 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
tattattatactttaagttc

SEQ ID NO: 8766 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aggaataatggtatattaaa

SEQ ID NO: 8767 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tatattcattttttatgtaa

SEQ ID NO: 8768 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tagaattaaaaaggtagtca

SEQ ID NO: 8769 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttatgttgaaatcctttatt

SEQ ID NO: 8770 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tcagtacctagaaatctatc

SEQ ID NO: 8771 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
caattggaaagtccttcagt

SEQ ID NO: 8772 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
agatgttatgttatttactg

SEQ ID NO: 8773 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ggtgaaattatagactaatg

SEQ ID NO: 8774 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
gaaaataaattcttaattat

SEQ ID NO: 8775 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ctgaatattaccaaatccaa

SEQ ID NO: 8776 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aataagtaaataagaggaag

SEQ ID NO: 8777 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tggttaccattaggtgtttg

SEQ ID NO: 8778 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tacttgggaggctgagacat

SEQ ID NO: 8779 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ctggcagatcacttgaggcc

SEQ ID NO: 8780 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGAT
attaaaacactctaaggtgg

SEQ ID NO: 8781 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gcatattaaatagaggaaag

SEQ ID NO: 8782 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atgccttgccagtaggtgag

SEQ ID NO: 8783 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
attaatgaacagtaaaggat

SEQ ID NO: 8784 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gtccccattaatgaacagta

SEQ ID NO: 8785 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tttgattttctcttcaaagt

SEQ ID NO: 8786 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
ttcttcatcatattgacaac

SEQ ID NO: 8787 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
cacccacgcaagtttctcta

SEQ ID NO: 8788 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tccttccacctaggttttaa

SEQ ID NO: 8789 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aaaaaaactagcctgactta

SEQ ID NO: 8790 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tgatgaggtggttttactta

SEQ ID NO: 8791 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
attacaaatttgagcaacta

SEQ ID NO: 8792 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tattagaacaaaagtcatta

SEQ ID NO: 8793 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
aattgtttcaaaccaagtaa

SEQ ID NO: 8794 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
taaattagcccctagaaagg

SEQ ID NO: 8795 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tgaataaattagcccctaga

SEQ ID NO: 8796 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aaagtggtatcttgatgaaa

SEQ ID NO: 8797 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ctggaccctagtgcagcaca

SEQ ID NO: 8798 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ttcagtgctccatatgaggc

SEQ ID NO: 8799 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tcagcctggctagagatact

SEQ ID NO: 8800 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
cattggtgtctgtgcattgg

SEQ ID NO: 8801 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGGAT
tttctttagggtcagtaact

SEQ ID NO: 8802 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
tttataaatctctatttctt

SEQ ID NO: 8803 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
acttcattaggataattatt

SEQ ID NO: 8804 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ggtactttgctaaacttcat

SEQ ID NO: 8805 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
attattgtattcttcaattc

SEQ ID NO: 8806 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
gtctgctattgaatcctcta

SEQ ID NO: 8807 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
cagtttgatcaagtctgcta

SEQ ID NO: 8808 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
atcctttacccagtttttga

SEQ ID NO: 8809 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttctagttctagatccttg

SEQ ID NO: 8810 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tatacccagtcatgggatgg

SEQ ID NO: 8811 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tttgggtatatacccagtca

SEQ ID NO: 8812 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
gcagcatgatttataatcct

SEQ ID NO: 8813 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ggttccaagtctttgctatt

SEQ ID NO: 8814 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tttccttgcgatagtttgct

SEQ ID NO: 8815 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tcattgttcaattcccacct

SEQ ID NO: 8816 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ttttattatactttaagttt

SEQ ID NO: 8817 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
ttttttggtgtccatctttt

SEQ ID NO: 8818 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
atttcttcttgctccactga

SEQ ID NO: 8819 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tttgggattctttgagtttc

SEQ ID NO: 8820 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tttgtcctatttgggattct

SEQ ID NO: 8821 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
ttctttagatttgtcctatt

SEQ ID NO: 8822 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
cgctcagcccctcaaagtgc

SEQ ID NO: 8823 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcagcctcccgagtagc

SEQ ID NO: 8824 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
attctctctgcctcagcctc

SEQ ID NO: 8825 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
ctcactgcaacttccacctc

SEQ ID NO: 8826 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tttcaccgtgttgcccaggc

SEQ ID NO: 8827 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tctttcttttttttccgaga

SEQ ID NO: 8828 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
agtttttttctttaagtatt

SEQ ID NO: 8829 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aatgatttatataatactat

SEQ ID NO: 8830 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttgacatttaacttttatat

SEQ ID NO: 8831 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ttttatttctgtatttttac

SEQ ID NO: 8832 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ttaactgtcttcttttgtga

SEQ ID NO: 8833 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tatctggagacagcatataa

SEQ ID NO: 8834 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGAGT
tatgttttcttaaatctgaa

SEQ ID NO: 8835 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
tcctcaattttggtatccct

SEQ ID NO: 8836 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
atgtgaaatccacagataca

SEQ ID NO: 8837 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gattgaaaacactgtattca

SEQ ID NO: 8838 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
acagggtgtcctctgtgtct

SEQ ID NO: 8839 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
tattttggctgatataatta

SEQ ID NO: 8840 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ataattgttatatcttcttg

SEQ ID NO: 8841 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
cgtatttacatgctttgatg

SEQ ID NO: 8842 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGGGT
gttctgttcattattgcaag

SEQ ID NO: 8843 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
gatggtatattaagatgctg

SEQ ID NO: 8844 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
cctgatatgtgatctatcct

SEQ ID NO: 8845 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tgtttaatttccacatattt

SEQ ID NO: 8846 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ttgacccattgctttttcaa

SEQ ID NO: 8847 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ttttcttagttatgcttgct

SEQ ID NO: 8848 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tcatttctggttttacatat

SEQ ID NO: 8849 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
cttggtaggttgtatatttt

SEQ ID NO: 8850 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
gtcctgtacatttctttttt

SEQ ID NO: 8851 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aagttttaagagagtttgag

SEQ ID NO: 8852 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tttcctcttcaaagttttaa

SEQ ID NO: 8853 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tctttgtctggctttgatat

SEQ ID NO: 8854 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
atgagtttttctactggatt

SEQ ID NO: 8855 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ggtgtgcatgagtttttcta

SEQ ID NO: 8856 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ttttctgtcctctggtgtgc

SEQ ID NO: 8857 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ctttttctacccattttgat

SEQ ID NO: 8858 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
gctcagggtggggttagtgc

SEQ ID NO: 8859 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
gtaaggcactgtgctcaggg

SEQ ID NO: 8860 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
caaatgtaaggcactgtgct

SEQ ID NO: 8861 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ttccttaaattaaaaaaaag

SEQ ID NO: 8862 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tgtgtcagggcctataaaag

SEQ ID NO: 8863 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tcccaggaattaaagcttct

SEQ ID NO: 8864 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttggaagatggtctgatccc

SEQ ID NO: 8865 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
aagccagggaagaaggcgtg

SEQ ID NO: 8866 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
aaaaagaaagattgtagagt

SEQ ID NO: 8867 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aaaaaaaaaaagaaagattg

SEQ ID NO: 8868 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tactcgggaggctgaggcag

SEQ ID NO: 8869 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGGAT
actttgggaggccgaggcgg

SEQ ID NO: 8870 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ataaatatctgttagatcta

SEQ ID NO: 8871 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
gaatatgtattttgttgctg

SEQ ID NO: 8872 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
agtgtttcatgtgatttgag

SEQ ID NO: 8873 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ctaacatgtgatctatcctg

SEQ ID NO: 8874 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tgtttaatttccacgtaatt

SEQ ID NO: 8875 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
ttcttccttctgcaaagttt

SEQ ID NO: 8876 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tctttcatttcagatattgt

SEQ ID NO: 8877 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
attcatattacttctttaaa

SEQ ID NO: 8878 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
attttttggaagaatttgag

SEQ ID NO: 8879 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
cctccttttcaattttttgg

SEQ ID NO: 8880 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tataatactggcctcataaa

SEQ ID NO: 8881 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
cttttctggtagcatactct

SEQ ID NO: 8882 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttttggatctatgttcatc

SEQ ID NO: 8883 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
taatatattgttgtgaattt

SEQ ID NO: 8884 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
cagtttgctaatatattgtt

SEQ ID NO: 8885 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
atgatgttttaaatgtgcta

SEQ ID NO: 8886 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ataaatcccaagtaatcatg

SEQ ID NO: 8887 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
gattttattatgaacatatg

SEQ ID NO: 8888 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tcctgcctaattgctatgga

SEQ ID NO: 8889 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ctttttcctgcctaattgct

SEQ ID NO: 8890 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tttatttcttgctttcttac

SEQ ID NO: 8891 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
acagttctcagtagagtgtt

SEQ ID NO: 8892 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tcagttttaacagttctcag

SEQ ID NO: 8893 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ttttgcaaactgcaacttta

SEQ ID NO: 8894 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ttaatttcttaatttctttg

SEQ ID NO: 8895 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tattttgatgctgttttaaa

SEQ ID NO: 8896 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
cattgaatctgtagattatt

SEQ ID NO: 8897 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gaattttgatagggattgca

SEQ ID NO: 8898 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
actgacattagaattttgat

SEQ ID NO: 8899 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
atttctgtgaaaactgacat

SEQ ID NO: 8900 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tttttattttattcaaatgt

SEQ ID NO: 8901 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
agctttatattttgaaatga

SEQ ID NO: 8902 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
aatcaattgactataaataa

SEQ ID NO: 8903 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
caatttcattcttttgcata

SEQ ID NO: 8904 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tcttttgttacctgtgcttt

SEQ ID NO: 8905 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tgagctttttatgtataatg

SEQ ID NO: 8906 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gtttattgattttctaggtg

SEQ ID NO: 8907 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
ggtgtgaggtaatatttcat

SEQ ID NO: 8908 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
cattttcactaacaatgtat

SEQ ID NO: 8909 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tatacctagaagtggaattg

SEQ ID NO: 8910 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
taccactatatacctagaag

SEQ ID NO: 8911 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aacgattttaattcctctaa

SEQ ID NO: 8912 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
aataatgctgaaatgaacat

SEQ ID NO: 8913 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
gatgggtacaggttgcatgt

SEQ ID NO: 8914 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ctttattcattcacctgttg

SEQ ID NO: 8915 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttagtttcattcatgttggg

SEQ ID NO: 8916 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tcctttagtttcattcatgt

SEQ ID NO: 8917 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ttttattttactttaagttc

SEQ ID NO: 8918 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
gtattgcctaggctgtcttc

SEQ ID NO: 8919 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tctttgcccatgcctatgtc

SEQ ID NO: 8920 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
atttaagttccttatagatt

SEQ ID NO: 8921 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
atcctttgcccactttttaa

SEQ ID NO: 8922 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
cacacagtcttccattatgg

SEQ ID NO: 8923 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttctgtctttaggtctttg

SEQ ID NO: 8924 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccagtaatgggattgctggg

SEQ ID NO: 8925 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tatacccagtaatgggattg

SEQ ID NO: 8926 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tttaggtatatacccagtaa

SEQ ID NO: 8927 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gattctatgtctttgccatt

SEQ ID NO: 8928 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
agtctatcactgatggtcat

SEQ ID NO: 8929 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggatatgatctcgttttttt

SEQ ID NO: 8930 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gctccattcatgtccctgca

SEQ ID NO: 8931 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
tacataggtaaacatgtcat

SEQ ID NO: 8932 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
taagttcaggggtacatgta

SEQ ID NO: 8933 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
ttgacttttattttaagttc

SEQ ID NO: 8934 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
acaaaaattgtgcttattta

SEQ ID NO: 8935 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tatttgcatctatgttcatc

SEQ ID NO: 8936 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aaatttgtcaaatgcttctt

SEQ ID NO: 8937 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
aacagcattaatgcatttaa

SEQ ID NO: 8938 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgatacacatggcacaaaga

SEQ ID NO: 8939 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
cttatgggatcacagtactg

SEQ ID NO: 8940 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tataatgaacataaacctta

SEQ ID NO: 8941 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ctataacagaataccacaga

SEQ ID NO: 8942 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atccatttgtgctactataa

SEQ ID NO: 8943 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
attgaatacgatgttagctg

SEQ ID NO: 8944 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
agtttttcagtttttcacca

SEQ ID NO: 8945 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ctgtgttaaatacaagtggc

SEQ ID NO: 8946 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
aacacttttttctttcagat

SEQ ID NO: 8947 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ttcctgatgtgtggagtctt

SEQ ID NO: 8948 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
taacagattttcctgatgtg

SEQ ID NO: 8949 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tcttttgatgttatcataaa

SEQ ID NO: 8950 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
agtcatttaattcgtgaata

SEQ ID NO: 8951 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
aatattaagtcatttaattc

SEQ ID NO: 8952 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
tattgaattcacagatcact

SEQ ID NO: 8953 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggattttgatatgtactgta

SEQ ID NO: 8954 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
attttagtaaataatgctat

SEQ ID NO: 8955 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ttgtggttccatatgaattt

SEQ ID NO: 8956 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agagtcttttgtggttccat

SEQ ID NO: 8957 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttaagattgctttggctatt

SEQ ID NO: 8958 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ctgcactctggcctgggcaa

SEQ ID NO: 8959 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tgggaggatcactgaagccc

SEQ ID NO: 8960 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tacttaggagcctgaggtgg

SEQ ID NO: 8961 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ctggaggatcacttgtggcc

SEQ ID NO: 8962 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
aactcgggaggctaaggctg

SEQ ID NO: 8963 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
gaaatgaggacctgtgggga

SEQ ID NO: 8964 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tatgagttaactatttatgc

SEQ ID NO: 8965 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tcttggcacccctgttgaat

SEQ ID NO: 8966 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gtgtattcttggcacccctg

SEQ ID NO: 8967 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
agttttcccaacattatttg

SEQ ID NO: 8968 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tcaattttatttttttatat

SEQ ID NO: 8969 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttttgtgtatggtataatat

SEQ ID NO: 8970 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gtttaaatgtttaatctatt

SEQ ID NO: 8971 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttttgctcttgtttgaattt

SEQ ID NO: 8972 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttgtctatttttgctcttgt

SEQ ID NO: 8973 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
taggttgctttttcaccctc

SEQ ID NO: 8974 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
gcaggagttccctatatatt

SEQ ID NO: 8975 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tgcatgccttcttaagttgc

SEQ ID NO: 8976 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gccctcattacagtttttat

SEQ ID NO: 8977 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
accttggcctcccaaagtgc

SEQ ID NO: 8978 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tggagtttcaccattttggc

SEQ ID NO: 8979 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttttgtattttcagtagaga

SEQ ID NO: 8980 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcagcttcccaagtagc

SEQ ID NO: 8981 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
gtctcactctgtcaccaggc

SEQ ID NO: 8982 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gtttgtttgtttgtttttga

SEQ ID NO: 8983 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gtctcggcctcccaaagtgc

SEQ ID NO: 8984 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
cggggtttcaccctgttagc

SEQ ID NO: 8985 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGGT
ttttgtatttttagtagaga

SEQ ID NO: 8986 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
ctcactgcaagctccgcctc

SEQ ID NO: 8987 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tttcgctctgtcgcccaggc

SEQ ID NO: 8988 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
tgttgtttttttttttgaga

SEQ ID NO: 8989 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
aacacctattatcttttgat

SEQ ID NO: 8990 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gaagtaaggactctgagatc

SEQ ID NO: 8991 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
catttaggttgttttcatat

SEQ ID NO: 8992 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ggatttccttctttataagg

SEQ ID NO: 8993 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
attcaagttgctgcatatgg

SEQ ID NO: 8994 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttttagttacttcaccgaag

SEQ ID NO: 8995 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ccattcttctctctgtttcc

SEQ ID NO: 8996 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
taattgaaactttattccca

SEQ ID NO: 8997 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ctgaccttttctgaatgatt

SEQ ID NO: 8998 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
cttttattttctgacctttt

SEQ ID NO: 8999 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
actgcaggaagtaaaatagg

SEQ ID NO: 9000 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ttctactgcaggaagtaaaa

SEQ ID NO: 9001 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
attcctcagtcttccctgca

SEQ ID NO: 9002 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tacaaaagagaataataatt

SEQ ID NO: 9003 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
taaatggtagaattacaaaa

SEQ ID NO: 9004 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gatctttggagactaaatgg

SEQ ID NO: 9005 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
gagataaaggagtctaattc

SEQ ID NO: 9006 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ttgtgatttgcaagagataa

SEQ ID NO: 9007 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cattaaaacattttagaggg

SEQ ID NO: 9008 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
tgttccattaaaacatttta

SEQ ID NO: 9009 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
attagtcctgtgtgtcaatg

SEQ ID NO: 9010 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tttcattatggatctagctc

SEQ ID NO: 9011 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
agctaaaaagtagtttcatt

SEQ ID NO: 9012 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttcatatatgttgagtaggg

SEQ ID NO: 9013 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tggtgtttcattcatatatg

SEQ ID NO: 9014 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
gatgaggttttaacctgcct

SEQ ID NO: 9015 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
aaaagaggcagcaattcagg

SEQ ID NO: 9016 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aaacagaaatgaatgagcaa

SEQ ID NO: 9017 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ccacatggagtgaaacagaa

SEQ ID NO: 9018 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
aaaagaatggctaacccaca

SEQ ID NO: 9019 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atgtagcaacggagaggcaa

SEQ ID NO: 9020 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agtaaaaatagatgctgcta

SEQ ID NO: 9021 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
caaaaaatatacatgacagt

SEQ ID NO: 9022 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
agtatgtgatgaaggttaga

SEQ ID NO: 9023 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAGT
gacttacccaaggtcatata

SEQ ID NO: 9024 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
caatcacaaaagtattatta

SEQ ID NO: 9025 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
aggtcacattctgaagtgct

SEQ ID NO: 9026 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tagtaaggatgccagtcaca

SEQ ID NO: 9027 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tgtctttctcctctactagt

SEQ ID NO: 9028 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
gtttctttgacctacgagaa

SEQ ID NO: 9029 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gtaatgaaaattaagacttg

SEQ ID NO: 9030 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tcaaggagtttatgtcatag

SEQ ID NO: 9031 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
agatatggttcctgagctca

SEQ ID NO: 9032 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tttattttgtgtaatatata

SEQ ID NO: 9033 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccaatgtttcctatagagga

SEQ ID NO: 9034 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tttttccaatgtttcctata

SEQ ID NO: 9035 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
atatttttcattgtaatgaa

SEQ ID NO: 9036 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ttttgtcgtctttatcatct

SEQ ID NO: 9037 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ggtagacaagcagcccaaat

SEQ ID NO: 9038 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
accatgtgaaaaagaaaata

SEQ ID NO: 9039 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tttacctaggatagcactgt

SEQ ID NO: 9040 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tcttaaatcctatgtttacc

SEQ ID NO: 9041 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tacatgttgaataaattgtt

SEQ ID NO: 9042 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aagtatgtaatgaatacatg

SEQ ID NO: 9043 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aattaaataataagtatgta

SEQ ID NO: 9044 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
catagtatgtcacttagtta

SEQ ID NO: 9045 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAAT
aaatataataaagatgtatt

SEQ ID NO: 9046 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tacagtttaaaacaccttgg

SEQ ID NO: 9047 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tttttacagtttaaaacacc

SEQ ID NO: 9048 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tttgtctaatctataattta

SEQ ID NO: 9049 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
ctgatagtagcctagtggtt

SEQ ID NO: 9050 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
cgattattatgtatgcagca

SEQ ID NO: 9051 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
attcttaaaggcaactttta

SEQ ID NO: 9052 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aactctgtttatggctattt

SEQ ID NO: 9053 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ctttacattaaatggacatg

SEQ ID NO: 9054 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
taagatttagaatgttactt

SEQ ID NO: 9055 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aattaactgggactaagatt

SEQ ID NO: 9056 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
cttcctgcttcacactatga

SEQ ID NO: 9057 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aagcatgggttctgttgcat

SEQ ID NO: 9058 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ttcctacatgaataagaagc

SEQ ID NO: 9059 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttcctagaacatgttcctac

SEQ ID NO: 9060 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgcttgggaggctgaggcag

SEQ ID NO: 9061 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
taaaaatacaaaaaaattag

SEQ ID NO: 9062 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ggtgggcagatcatgaggtc

SEQ ID NO: 9063 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
attttaatagatattggacg

SEQ ID NO: 9064 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
agttgtaagtgtcccatttc

SEQ ID NO: 9065 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gttccgaatgttttgccctt

SEQ ID NO: 9066 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAAT
aagtcaagttccaaatcgtt

SEQ ID NO: 9067 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tgagtgtattaacaccacag

SEQ ID NO: 9068 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tttgtttgctggcaagttct

SEQ ID NO: 9069 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tggctgatattcagcatcat

SEQ ID NO: 9070 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
taggagcaattccttccatc

SEQ ID NO: 9071 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
cttttgaatactaggtcgtt

SEQ ID NO: 9072 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
taatcatgcttttctttctt

SEQ ID NO: 9073 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
agagtaggcatttaataaac

SEQ ID NO: 9074 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gcttggcacactgctgagtg

SEQ ID NO: 9075 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
ttgtcttgcttggcacactg

SEQ ID NO: 9076 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
atttgtaagcctggtgatca

SEQ ID NO: 9077 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttatacatttcttttttttc

SEQ ID NO: 9078 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
atctttaatgctggtaataa

SEQ ID NO: 9079 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
caccaatagtttctctatgg

SEQ ID NO: 9080 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tggagaatgtctcaaaaaaa

SEQ ID NO: 9081 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
agattctcaatccttttgtg

SEQ ID NO: 9082 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
cgtagaaccagccaaatcta

SEQ ID NO: 9083 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aggcttacatataaagtatt

SEQ ID NO: 9084 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ctgaaaagcagaaataaaga

SEQ ID NO: 9085 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
gaattgccctggatgaaaac

SEQ ID NO: 9086 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
taaatgccacaggaattgcc

SEQ ID NO: 9087 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tggagagtgttaaatgccac

SEQ ID NO: 9088 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
taagtaaataagaaaatctg

SEQ ID NO: 9089 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tttaacacatttgtacttga

SEQ ID NO: 9090 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aatctttaacacatttgtac

SEQ ID NO: 9091 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
cttaatacattgcagaaaag

SEQ ID NO: 9092 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccatgactaccatggcagag

SEQ ID NO: 9093 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
atgacccatgactaccatgg

SEQ ID NO: 9094 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tgtaagaatctgatgaaagt

SEQ ID NO: 9095 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttgaggtcacatagactgt

SEQ ID NO: 9096 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tggtcagtgactagatgtat

SEQ ID NO: 9097 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
taccacatggtagggaggca

SEQ ID NO: 9098 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tttcagacatttcatgactg

SEQ ID NO: 9099 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tgatacaggaatatacagta

SEQ ID NO: 9100 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
acaagggcacataatgatac

SEQ ID NO: 9101 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
cccggtccccaaagagtgag

SEQ ID NO: 9102 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
tagaccccggtccccaaaga

SEQ ID NO: 9103 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tacatagaccccggtcccca

SEQ ID NO: 9104 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
gtgttgtgatataaaaaaca

SEQ ID NO: 9105 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gcatattgtagtcagcttgt

SEQ ID NO: 9106 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
catgccgcagggctattttg

SEQ ID NO: 9107 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tacaggtgaattggatgcag

SEQ ID NO: 9108 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ttatctgtattacaggtgaa

SEQ ID NO: 9109 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gttctttatctgtattacag

SEQ ID NO: 9110 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cttaattttttgagcattaa

SEQ ID NO: 9111 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tttgtgcagaaaggtggtat

SEQ ID NO: 9112 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ccaggatggggataagaaac

SEQ ID NO: 9113 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
tgagtcagaaactccaggat

SEQ ID NO: 9114 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
acctactgagtcagaaactc

SEQ ID NO: 9115 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tggatctcaccccagaccta

SEQ ID NO: 9116 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
aaaaaaaaaaaagcaaattc

SEQ ID NO: 9117 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tactagggaggctgaggcag

SEQ ID NO: 9118 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gacggacggatcatgaggtc

SEQ ID NO: 9119 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGGAT
caaacttattaaaaagacgg

SEQ ID NO: 9120 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ccgtccaccaggagacataa

SEQ ID NO: 9121 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gctattttatgcctctgttc

SEQ ID NO: 9122 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aactaccataacctagcttt

SEQ ID NO: 9123 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gcagagacaaacaagttata

SEQ ID NO: 9124 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cttaatttgcacttaggctg

SEQ ID NO: 9125 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tttgagaaaactaaagctca

SEQ ID NO: 9126 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aaataacattgcaaagtaag

SEQ ID NO: 9127 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
atatttgtttaagaaactac

SEQ ID NO: 9128 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
caaacaatagaatgatccaa

SEQ ID NO: 9129 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tatctaatattgtcaaacaa

SEQ ID NO: 9130 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
cagtgcatattgtttaacaa

SEQ ID NO: 9131 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ctattatatattaatatata

SEQ ID NO: 9132 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
acaatgggtatgtagaaatt

SEQ ID NO: 9133 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
gggtttaaaatataaaaaca

SEQ ID NO: 9134 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
ataatgttcttattttttaa

SEQ ID NO: 9135 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
ttatctagatttgaaggaat

SEQ ID NO: 9136 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
agagccttatctagatttga

SEQ ID NO: 9137 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gagttgcttttagtgagttt

SEQ ID NO: 9138 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
ttcctgttgagttgctttta

SEQ ID NO: 9139 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ataccatcttattgttcctg

SEQ ID NO: 9140 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
atgcatgatttctattcaaa

SEQ ID NO: 9141 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttaaatttttagatttaata

SEQ ID NO: 9142 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
atcacacacttcattttgac

SEQ ID NO: 9143 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
acacttttagggcttagctt

SEQ ID NO: 9144 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
taagacatagatttagttga

SEQ ID NO: 9145 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
atactaagacatagatttag

SEQ ID NO: 9146 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atttgccccaactcaaaatc

SEQ ID NO: 9147 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
agggcagaagcaatcttgtt

SEQ ID NO: 9148 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
gataagaactcaaatttctt

SEQ ID NO: 9149 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ttttccatggaactaattca

SEQ ID NO: 9150 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ctacacaggatgtgaggcaa

SEQ ID NO: 9151 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
agacatcgtctcctgctaca

SEQ ID NO: 9152 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
cctattcttccctcgaaaaa

SEQ ID NO: 9153 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gacatctggaaatactacat

SEQ ID NO: 9154 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tctgctaaatacgtagcttt

SEQ ID NO: 9155 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gcaaatttaagagtggcatg

SEQ ID NO: 9156 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gtgaatgactgggcaaattt

SEQ ID NO: 9157 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ttaagtggaaaataatggat

SEQ ID NO: 9158 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
gtgttcttaagtggaaaata

SEQ ID NO: 9159 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
attgggaattaagttccaac

SEQ ID NO: 9160 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
cctcttaatactgttacatt

SEQ ID NO: 9161 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ggtgttcactgagagccaaa

SEQ ID NO: 9162 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
gctcatggcatcacatggcg

SEQ ID NO: 9163 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tcttgctggtgggcacacca

SEQ ID NO: 9164 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
aagctgggaagtctaaggtg

SEQ ID NO: 9165 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tctaccttttattgctgtaa

SEQ ID NO: 9166 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gtgtgtgtttatagaaagat

SEQ ID NO: 9167 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tgtctgatttctgcaggctt

SEQ ID NO: 9168 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
cttatattatttgctactca

SEQ ID NO: 9169 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ctgaatcagaaactctgggg

SEQ ID NO: 9170 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
acatactgaatcagaaactc

SEQ ID NO: 9171 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gcccccaaccccaagacata

SEQ ID NO: 9172 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
atctacagcagttgttcttg

SEQ ID NO: 9173 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
attttgggacacagatttgg

SEQ ID NO: 9174 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
caaatataatgcaaagcaca

SEQ ID NO: 9175 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
gtgagtataacctcctgttc

SEQ ID NO: 9176 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
atttaaagtgatgattctca

SEQ ID NO: 9177 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGGT
ctcttaaactgtaaatatga

SEQ ID NO: 9178 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aaataagaagaaattataga

SEQ ID NO: 9179 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
aaaaaatgaaaaatgataaa

SEQ ID NO: 9180 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGGAT
cctctatgagaattctaact

SEQ ID NO: 9181 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttatcttaggtttcctctat

SEQ ID NO: 9182 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ctgcactccagcttgggcga

SEQ ID NO: 9183 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
cccggtaggcagaggtttca

SEQ ID NO: 9184 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tactcaggaggctgaggcag

SEQ ID NO: 9185 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
caggtggatcacctgaggtc

SEQ ID NO: 9186 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
actttgagagtccgaggcag

SEQ ID NO: 9187 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
gcctgtaatcccagcacttt

SEQ ID NO: 9188 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
gaattcatacagcatcatat

SEQ ID NO: 9189 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tatcgagcttttaagaaaag

SEQ ID NO: 9190 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
aagtgctttaaaatttaacc

SEQ ID NO: 9191 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tctcccagtcttatttttct

SEQ ID NO: 9192 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tacccattattatcatttca

SEQ ID NO: 9193 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ttcaaagaactgttgaatac

SEQ ID NO: 9194 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ataataaattcaaagaactg

SEQ ID NO: 9195 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ccagaatggcagtggggcag

SEQ ID NO: 9196 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tgcgacttgcccttcatctc

SEQ ID NO: 9197 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tgtaaaattggaagataaga

SEQ ID NO: 9198 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atttgaatgtcattcttgtt

SEQ ID NO: 9199 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gattttttaaaaaatatgat

SEQ ID NO: 9200 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tgacattgtaacatttataa

SEQ ID NO: 9201 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ccagtggaaatatatctgtg

SEQ ID NO: 9202 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
cttttgagtacattttaaaa

SEQ ID NO: 9203 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aattgttgatgtaggtactt

SEQ ID NO: 9204 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tcaccaatgcctggtgttgg

SEQ ID NO: 9205 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
attctggaaatgcttctaaa

SEQ ID NO: 9206 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
aaagaccattaagattatcc

SEQ ID NO: 9207 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aagttgtgcatgattgaaac

SEQ ID NO: 9208 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atttttcctgttttttttaa

SEQ ID NO: 9209 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tgtttcagcagtcttagcat

SEQ ID NO: 9210 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
cagagatcatgagtcttttt

SEQ ID NO: 9211 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atgatcaggtgtcagagatc

SEQ ID NO: 9212 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aattttaatggagaaagagg

SEQ ID NO: 9213 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tttataacagtggctggcca

SEQ ID NO: 9214 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ggtggggaaaaaggggagtg

SEQ ID NO: 9215 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tcctactggtggggaaaaag

SEQ ID NO: 9216 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
attaacatggtactaggcac

SEQ ID NO: 9217 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ctttgaaggataatatatgg

SEQ ID NO: 9218 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
gaagctttgaaggataatat

SEQ ID NO: 9219 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tttttagagctgaagctttg

SEQ ID NO: 9220 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ggaagcaccgcattaatgga

SEQ ID NO: 9221 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
catacacaaaataggagtaa

SEQ ID NO: 9222 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
cagaagagcatacacaaaat

SEQ ID NO: 9223 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tcttgctctgttgcccaggc

SEQ ID NO: 9224 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttttttttttttttttgaga

SEQ ID NO: 9225 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ttgactttcattttatccaa

SEQ ID NO: 9226 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
taaatataatattaaccacg

SEQ ID NO: 9227 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gaacgtagaataagaagaat

SEQ ID NO: 9228 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaagcagaacgtagaataag

SEQ ID NO: 9229 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agagtattgaaagcagaacg

SEQ ID NO: 9230 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aaaactgctaaggataattt

SEQ ID NO: 9231 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aacagtttcccaaaactgct

SEQ ID NO: 9232 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccctctgcacttcaattcca

SEQ ID NO: 9233 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
attcctccagaatttggggg

SEQ ID NO: 9234 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
gcctgattcctccagaattt

SEQ ID NO: 9235 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gatggcttgcctgattcctc

SEQ ID NO: 9236 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
ttgtctttgtatttcaagga

SEQ ID NO: 9237 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gaagctagaacccctgtggg

SEQ ID NO: 9238 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
cagaaataaatgagtggtaa

SEQ ID NO: 9239 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tatacacaaaacagaaataa

SEQ ID NO: 9240 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tgttgtggctcctcagaaag

SEQ ID NO: 9241 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
agtaaatgacagagctatca

SEQ ID NO: 9242 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ttattttaccaatgatgaag

SEQ ID NO: 9243 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
agcttatacttattgtgttt

SEQ ID NO: 9244 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
attacaaaaaaattaaagtt

SEQ ID NO: 9245 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gctgactcacatatgtgact

SEQ ID NO: 9246 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
aaagctctattttccttacc

SEQ ID NO: 9247 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tcactgcaaacacaaccctg

SEQ ID NO: 9248 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
gctgaggaacactgagctta

SEQ ID NO: 9249 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
aatgagtgtgtacacatata

SEQ ID NO: 9250 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ggggcattatatgagcctga

SEQ ID NO: 9251 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
catgggggcattatatgagc

SEQ ID NO: 9252 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
acttatgtgtggaaagtagc

SEQ ID NO: 9253 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tggcagaagatatgaggtgc

SEQ ID NO: 9254 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ggttgatctgatactgtttc

SEQ ID NO: 9255 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ttgcctcatagacagtcttc

SEQ ID NO: 9256 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aagtttcattatactaaaaa

SEQ ID NO: 9257 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gagagttgaaagagatctag

SEQ ID NO: 9258 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
cacatacaagcagcttccat

SEQ ID NO: 9259 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
gggaaaacagatggtagttt

SEQ ID NO: 9260 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
cagggtctagaaagacgaac

SEQ ID NO: 9261 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
gaaacgtaaatggtgctttt

SEQ ID NO: 9262 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
caaatgagtaactgtagagc

SEQ ID NO: 9263 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tggagaagagaagaatacaa

SEQ ID NO: 9264 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ctcagagcaatggagaagag

SEQ ID NO: 9265 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gactcttagttgactgttag

SEQ ID NO: 9266 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttgcagagaattataattct

SEQ ID NO: 9267 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
cttcaacagtcagtcttgca

SEQ ID NO: 9268 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gtcgttggcacaattagtcc

SEQ ID NO: 9269 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gaaagttcattggccctagt

SEQ ID NO: 9270 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
atcagtttgcaaaacaggga

SEQ ID NO: 9271 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
cagatggctataatagaaaa

SEQ ID NO: 9272 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
caggcattatccttgctgcc

SEQ ID NO: 9273 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tcatggcaagttgttttacc

SEQ ID NO: 9274 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
ctcatgctgccaagttaaca

SEQ ID NO: 9275 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tattaaaaattttatttatt

SEQ ID NO: 9276 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tgttgaaattatttggttga

SEQ ID NO: 9277 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aattggggattacagaagac

SEQ ID NO: 9278 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
gaggagactgaagagaaatt

SEQ ID NO: 9279 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tcagagggtttttaccatag

SEQ ID NO: 9280 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
gtttagaaaggtgtatttca

SEQ ID NO: 9281 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tttcttttgaacttaatttc

SEQ ID NO: 9282 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atctggatcttctaatcaag

SEQ ID NO: 9283 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
aatacttgaaacagtttcat

SEQ ID NO: 9284 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agtcacatttgtttttaact

SEQ ID NO: 9285 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
acaaaagaatgcgttaatga

SEQ ID NO: 9286 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atggacaaaagaatgcgtta

SEQ ID NO: 9287 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aacaagggtttgatggacaa

SEQ ID NO: 9288 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
atacataaaagatacgtaac

SEQ ID NO: 9289 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
aaaggaaatcatgtacagag

SEQ ID NO: 9290 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gcataacaatttttgctgcc

SEQ ID NO: 9291 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tacttactcctcaacctcaa

SEQ ID NO: 9292 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
accagaatccaaatggtttt

SEQ ID NO: 9293 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ctccagacaggatactggac

SEQ ID NO: 9294 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
aactaatctttccctccaga

SEQ ID NO: 9295 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttttatctgccaaatatgtc

SEQ ID NO: 9296 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
taacatccacctggtagtcc

SEQ ID NO: 9297 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
catctcaaaatcattacctg

SEQ ID NO: 9298 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
acccccatttttaaaatcta

SEQ ID NO: 9299 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
catgtatgctaattattact

SEQ ID NO: 9300 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
attgttgtttcagaatgttt

SEQ ID NO: 9301 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ctcccttaatattgttgttt

SEQ ID NO: 9302 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggtctgctttcagcacacca

SEQ ID NO: 9303 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atttctgacagtttaacaac

SEQ ID NO: 9304 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gcttttaacaacagacaagc

SEQ ID NO: 9305 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cctttccttaaggtaagtta

SEQ ID NO: 9306 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAAT
ccatacttctgctattcaaa

SEQ ID NO: 9307 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tccagagagaataatccaga

SEQ ID NO: 9308 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gcatattactactgtccaga

SEQ ID NO: 9309 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
atagaccagcatccagaaag

SEQ ID NO: 9310 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tccagatagaataggccaga

SEQ ID NO: 9311 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
acatacttccaccatccaga

SEQ ID NO: 9312 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tgatgtgaaattgctaaatg

SEQ ID NO: 9313 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tttttaatttttgtgctatt

SEQ ID NO: 9314 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aaacagaatttcaataatga

SEQ ID NO: 9315 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
attatttgcaaatcaaaaaa

SEQ ID NO: 9316 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gtatatcaaattgtttctca

SEQ ID NO: 9317 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
actataaattttactgatat

SEQ ID NO: 9318 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
taaagagtctctcttttctt

SEQ ID NO: 9319 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ttcactgtagttacttttta

SEQ ID NO: 9320 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tcatctaaaattttatgagg

SEQ ID NO: 9321 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tgaaaactcaatacttgtta

SEQ ID NO: 9322 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
taccaggtgcatcttgtcaa

SEQ ID NO: 9323 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
agaaaataaccttatatcaa

SEQ ID NO: 9324 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gcaagcattacagactcagt

SEQ ID NO: 9325 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aagccaagtagaggactatg

SEQ ID NO: 9326 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
agattatataactctttttg

SEQ ID NO: 9327 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tccaatgtttatgtaaagta

SEQ ID NO: 9328 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
agataataattatttaagta

SEQ ID NO: 9329 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAAT
tctgtttttatatcatttta

SEQ ID NO: 9330 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
ttccctgaaaaagattaact

SEQ ID NO: 9331 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
agcaaaatcttcttaaccaa

SEQ ID NO: 9332 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gtttttatttcctcaatcat

SEQ ID NO: 9333 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
agtttactaacttttctaat

SEQ ID NO: 9334 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
cagcttagttggaaatctct

SEQ ID NO: 9335 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tcatgctgttatggttttta

SEQ ID NO: 9336 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tactcaagaggctgaggcag

SEQ ID NO: 9337 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gtaaattacataatcaggat

SEQ ID NO: 9338 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
aaattagtaaattacataat

SEQ ID NO: 9339 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tatgaacatgacatgactct

SEQ ID NO: 9340 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaattaaatgaagtatgaaa

SEQ ID NO: 9341 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttggtctacaagagctgggc

SEQ ID NO: 9342 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
agcatgggcttgtcagaatg

SEQ ID NO: 9343 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
actgagaagcatgggcttgt

SEQ ID NO: 9344 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
atttgttgatggattgaaca

SEQ ID NO: 9345 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
agagctgaagggatttgttg

SEQ ID NO: 9346 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tattttgaagttagagctga

SEQ ID NO: 9347 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tatagtgagggtgtgacatg

SEQ ID NO: 9348 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
atggtagagttttgtatagt

SEQ ID NO: 9349 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gggagcttagactagtatgg

SEQ ID NO: 9350 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
gcagaagctggaagatttct

SEQ ID NO: 9351 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGAAT
gcaatcttaagagtggaagg

SEQ ID NO: 9352 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
atctcacaatgtgcaatctt

SEQ ID NO: 9353 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
agacatttgaagaacattat

SEQ ID NO: 9354 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggctgaggcacgagaattac

SEQ ID NO: 9355 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tacttgtgaggctgaggcac

SEQ ID NO: 9356 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gtgggcgatcacttgaggcc

SEQ ID NO: 9357 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ttaaaagttaaggtcagagg

SEQ ID NO: 9358 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
agaataatgaaagatgggaa

SEQ ID NO: 9359 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ccaagaggccaaaatagatg

SEQ ID NO: 9360 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gaaggcacatgccccaaggt

SEQ ID NO: 9361 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tggagggaaagtattttagg

SEQ ID NO: 9362 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agcacataaatatgctatca

SEQ ID NO: 9363 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
atatggaaaagaggaatacc

SEQ ID NO: 9364 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ggagaaggtatatggaaaag

SEQ ID NO: 9365 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
gcagagacttcatacagtct

SEQ ID NO: 9366 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tactgagggagcatatatct

SEQ ID NO: 9367 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
acatcaatgaaaatactttt

SEQ ID NO: 9368 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
atgatcatgacttaaaattc

SEQ ID NO: 9369 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agattttccctattcatttt

SEQ ID NO: 9370 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tgtccatgttacagagattt

SEQ ID NO: 9371 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
cagcaaactacaaagagtgc

SEQ ID NO: 9372 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
aaagacatcagcaaactaca

SEQ ID NO: 9373 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
actggtttcttataacattc

SEQ ID NO: 9374 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ttctacttttcttattcttc

SEQ ID NO: 9375 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ccacatcacagcgatgctaa

SEQ ID NO: 9376 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
agatatctcatctgtaaaat

SEQ ID NO: 9377 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tctaggtaaaaatacaagcc

SEQ ID NO: 9378 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tactacttctggaatttgtc

SEQ ID NO: 9379 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gctgaatttcttactacttc

SEQ ID NO: 9380 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
cctgtatgctttctgatatg

SEQ ID NO: 9381 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
atgtgagaatccttggcctc

SEQ ID NO: 9382 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttgcatgcacactaaaatgt

SEQ ID NO: 9383 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gatagggcccaagcccttaa

SEQ ID NO: 9384 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ctttacctctaacctcactc

SEQ ID NO: 9385 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ttcctctctctatttcttta

SEQ ID NO: 9386 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
cttttatttgtcttagagtt

SEQ ID NO: 9387 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
ctttggtcttttatttgtct

SEQ ID NO: 9388 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ctggtccttttaatcaaaaa

SEQ ID NO: 9389 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
accagaatacaagttaatga

SEQ ID NO: 9390 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tcccagatcaatggaaccac

SEQ ID NO: 9391 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gtcactagagctctctaagc

SEQ ID NO: 9392 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
gcattccttaattagtgttc

SEQ ID NO: 9393 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aagaagcagaggctgaacct

SEQ ID NO: 9394 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
attaaaccggtcaagctcct

SEQ ID NO: 9395 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
atgaactacctggtggggtg

SEQ ID NO: 9396 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
actctaaatgaactacctgg

SEQ ID NO: 9397 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ataaggcttaaatatcatat

SEQ ID NO: 9398 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
cttttttcataatactttgc

SEQ ID NO: 9399 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
taataaagtttattatttta

SEQ ID NO: 9400 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
cacttgtattatattgcaaa

SEQ ID NO: 9401 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
actaaaatgttatatacaaa

SEQ ID NO: 9402 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
attttcttcgatctttgttt

SEQ ID NO: 9403 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
cttatatgatcataatgaca

SEQ ID NO: 9404 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tcatggttactcataaagct

SEQ ID NO: 9405 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
acaatatttgggaaatttga

SEQ ID NO: 9406 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tcacatgtcatttagcaaat

SEQ ID NO: 9407 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ataaagttgtaacttaataa

SEQ ID NO: 9408 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttaatacaaattcatagatt

SEQ ID NO: 9409 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aatttaatgtggtacccatc

SEQ ID NO: 9410 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
taggtgataataatagcatt

SEQ ID NO: 9411 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tctaggccaacatagattgg

SEQ ID NO: 9412 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
atcaaactcctggacctggt

SEQ ID NO: 9413 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tcagtttaaataacatgttt

SEQ ID NO: 9414 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tttaaattaaactaatttag

SEQ ID NO: 9415 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aagcctattctatagtttta

SEQ ID NO: 9416 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
agtttatccaacatcgtttc

SEQ ID NO: 9417 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
agtcttctaaatatggtact

SEQ ID NO: 9418 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tcacgtgcagccgagaggtc

SEQ ID NO: 9419 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
agggcctggtcttaacttca

SEQ ID NO: 9420 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
aatattgtgtctaatagcag

SEQ ID NO: 9421 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaagtcagaattctgcaaat

SEQ ID NO: 9422 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ttcatgaatttagctaaagt

SEQ ID NO: 9423 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tgatgtttgaagatgctttc

SEQ ID NO: 9424 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gatacactatataaaatcac

SEQ ID NO: 9425 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
atgtaaaattctgtgccaag

SEQ ID NO: 9426 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tgtcccattgaacaataata

SEQ ID NO: 9427 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
caagaaaacattgaatgtct

SEQ ID NO: 9428 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aatgcattcccaagaaaaca

SEQ ID NO: 9429 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
agtatggaaatagttactgt

SEQ ID NO: 9430 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gcaagtatagatttcaaagg

SEQ ID NO: 9431 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aatatggtgatgcctactgt

SEQ ID NO: 9432 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gaaaactaaacaacagatga

SEQ ID NO: 9433 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
acttctgattcctaatacta

SEQ ID NO: 9434 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
atattattcaataaaaaggc

SEQ ID NO: 9435 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ctattatacatttaaaatgt

SEQ ID NO: 9436 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tctcgattacctcaaggggg

SEQ ID NO: 9437 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
ctctctctcgattacctcaa

SEQ ID NO: 9438 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tttcacagctatagtgttgt

SEQ ID NO: 9439 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
cataagtttacaatcaagat

SEQ ID NO: 9440 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
caatcaaagggaaaaccatg

SEQ ID NO: 9441 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ctctttgagtaaggtttttg

SEQ ID NO: 9442 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ttcagcatcaatcattctct

SEQ ID NO: 9443 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
attctaggctctgctcctta

SEQ ID NO: 9444 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
caactttcttactgtctttt

SEQ ID NO: 9445 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ctacacaattaaattaaaag

SEQ ID NO: 9446 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tatgtgtggatttcttctca

SEQ ID NO: 9447 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
atgccacatagtaactatgt

SEQ ID NO: 9448 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
atttttgttctacaccagaa

SEQ ID NO: 9449 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gaaggaaaaaaataaaggcc

SEQ ID NO: 9450 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
caattttaaaaactctataa

SEQ ID NO: 9451 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttgaggcattaccttttaaa

SEQ ID NO: 9452 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttccactgatcaataatatc

SEQ ID NO: 9453 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gacaacagaagaaaatacag

SEQ ID NO: 9454 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ccataattagaatgtgagcc

SEQ ID NO: 9455 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aagttttagttgcccataat

SEQ ID NO: 9456 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
atggaactgtgtgtttcacg

SEQ ID NO: 9457 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tgacctcattatttcaccaa

SEQ ID NO: 9458 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gtgaaatcactggttttatt

SEQ ID NO: 9459 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tcacgtaagttttcatgtta

SEQ ID NO: 9460 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
acagagcacagagagagccc

SEQ ID NO: 9461 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
atagataatatttacgaagc

SEQ ID NO: 9462 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
tttccttgccctccttcatt

SEQ ID NO: 9463 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tagcaaaagctgcctacata

SEQ ID NO: 9464 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaaaaactgaatattcagtt

SEQ ID NO: 9465 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tcatcctcttaagaaaaaaa

SEQ ID NO: 9466 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aaaagatgaggtacatgtta

SEQ ID NO: 9467 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aacatatgcatatatatgtt

SEQ ID NO: 9468 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tcttcaactagagcctaaat

SEQ ID NO: 9469 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ctattttattccagaatatg

SEQ ID NO: 9470 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
catagaaaactattttattc

SEQ ID NO: 9471 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
ttttctatttcaaatttggt

SEQ ID NO: 9472 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tttataatctagttcatatt

SEQ ID NO: 9473 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gggcaggaatctctgccaat

SEQ ID NO: 9474 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aatagttctaggatgggggc

SEQ ID NO: 9475 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tgactgaactttaatagttc

SEQ ID NO: 9476 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tttaattttagcatactttg

SEQ ID NO: 9477 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gattaatatgtattgcctta

SEQ ID NO: 9478 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aagtaatattactcattgat

SEQ ID NO: 9479 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttgataggccttgcctatga

SEQ ID NO: 9480 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aaagttgataggccttgcct

SEQ ID NO: 9481 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccctgcttctagtataaact

SEQ ID NO: 9482 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
ttagtacacatctagaaagt

SEQ ID NO: 9483 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ataattctggttatgtattt

SEQ ID NO: 9484 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ttgattataaaagtaaaatg

SEQ ID NO: 9485 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gcatgatctgtagattttta

SEQ ID NO: 9486 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aatatcaaactggatcagtc

SEQ ID NO: 9487 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ctcacaggggtaatatcaaa

SEQ ID NO: 9488 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
gtacctaaccttcttctcac

SEQ ID NO: 9489 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ttcaaatatattgcttaacg

SEQ ID NO: 9490 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tgattgtttttaagtctctg

SEQ ID NO: 9491 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tcaatttttaaatagtagag

SEQ ID NO: 9492 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
taaattcaatttttaaatag

SEQ ID NO: 9493 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tgcttgcatttaaggaaaaa

SEQ ID NO: 9494 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gccacctcaccccctatact

SEQ ID NO: 9495 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
caatcaagaaatgctaattt

SEQ ID NO: 9496 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
gaaaaatctttccatcttca

SEQ ID NO: 9497 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttttttcaggttgtttcca

SEQ ID NO: 9498 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tttttaaaagcactcttctg

SEQ ID NO: 9499 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
catttgactttgaaagattt

SEQ ID NO: 9500 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
actagtccattgaggatgca

SEQ ID NO: 9501 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ggacactaaactagtccatt

SEQ ID NO: 9502 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
cttcatgtacttcaaaggta

SEQ ID NO: 9503 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tttttggccccctataaata

SEQ ID NO: 9504 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gcccagaattataataggca

SEQ ID NO: 9505 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
attttctatgactctctgcc

SEQ ID NO: 9506 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tagaaaatatatatgaaaat

SEQ ID NO: 9507 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
caaaagttaatttttactta

SEQ ID NO: 9508 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tgcagttactaggcataatt

SEQ ID NO: 9509 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tgaaaatgtcaaaagaattg

SEQ ID NO: 9510 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttcctttatgaaaatgtcaa

SEQ ID NO: 9511 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
attgctaccctgaataaaat

SEQ ID NO: 9512 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tatctgggcatattgctacc

SEQ ID NO: 9513 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
acttaactacattggcataa

SEQ ID NO: 9514 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tttgttatttttggctattt

SEQ ID NO: 9515 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
cctattttacttaagggtac

SEQ ID NO: 9516 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
tgaataaacctattttactt

SEQ ID NO: 9517 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
catgttaagatcttaactat

SEQ ID NO: 9518 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
taaggctatattaggggcta

SEQ ID NO: 9519 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tctcaggacaatgtattaag

SEQ ID NO: 9520 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agtaaaactgattttacttc

SEQ ID NO: 9521 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
ttgtacatttgctgattcat

SEQ ID NO: 9522 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
acctctgtaatggtgtaatt

SEQ ID NO: 9523 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tgccatagaaaggcaagaaa

SEQ ID NO: 9524 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
ggttagtcatggacgtatct

SEQ ID NO: 9525 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGGAT
aagaaagcacgcacacacac

SEQ ID NO: 9526 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ggatcaaacacatttgagag

SEQ ID NO: 9527 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGGAT
acagacagcagctgagaaca

SEQ ID NO: 9528 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
atgagcagcttgctggaaag

SEQ ID NO: 9529 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ccaacacttttggcagctgg

SEQ ID NO: 9530 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tgccacgataaggcccaaag

SEQ ID NO: 9531 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
cctttacctttccaggggag

SEQ ID NO: 9532 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tttcttctccacaccattca

SEQ ID NO: 9533 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
gtagttccaaaacaaagcaa

SEQ ID NO: 9534 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ctgatgctgtgacaaccctc

SEQ ID NO: 9535 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
cattaatcacgggattgtgt

SEQ ID NO: 9536 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGAT
atgctaactttcattaatca

SEQ ID NO: 9537 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
agtcagagttgtagataggt

SEQ ID NO: 9538 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cttaaggaaagaagaaaagt

SEQ ID NO: 9539 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttgaggaggtaggggaaata

SEQ ID NO: 9540 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
agatggttattgatacaatt

SEQ ID NO: 9541 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttacaattcaacccacaaca

SEQ ID NO: 9542 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ggacttcaacataacttttg

SEQ ID NO: 9543 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
aagatcacactcaaacatgc

SEQ ID NO: 9544 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ttataaggaccccagttata

SEQ ID NO: 9545 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ataagattgtgagctgatcc

SEQ ID NO: 9546 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
aaagttaaaatataagggct

SEQ ID NO: 9547 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGAT
cagctgcaacaatttaatat

SEQ ID NO: 9548 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tatgctctaagcactgtgct

SEQ ID NO: 9549 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
actgaactgatggctcttct

SEQ ID NO: 9550 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atactcttttcactgtttct

SEQ ID NO: 9551 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gttatctcaaaggtacccat

SEQ ID NO: 9552 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tctgaagagatagtcagtgt

SEQ ID NO: 9553 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atcagaaaataaccaaagag

SEQ ID NO: 9554 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
agacagttaaaaatacactc

SEQ ID NO: 9555 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gtttctcaacagagtttatg

SEQ ID NO: 9556 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ctagcatcctggtttctcaa

SEQ ID NO: 9557 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
attttctttattcaggggct

SEQ ID NO: 9558 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
caacttaatccctagcttac

SEQ ID NO: 9559 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aatggtaaatgttcaaagct

SEQ ID NO: 9560 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
ctattgaatcgttggatgac

SEQ ID NO: 9561 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tctggtgttctattgaatcg

SEQ ID NO: 9562 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gaataagttctggtgttcta

SEQ ID NO: 9563 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
caaagctacagtgagataga

SEQ ID NO: 9564 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tagtagaatagtggttatcg

SEQ ID NO: 9565 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gttgtcatagaagtagatag

SEQ ID NO: 9566 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
tcacacatatgtggaatcta

SEQ ID NO: 9567 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tcaaatatctcacacatatg

SEQ ID NO: 9568 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atcctgttatttgtggcaac

SEQ ID NO: 9569 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttgaagagatacagtaaaca

SEQ ID NO: 9570 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gttctttaaaaaattaaaaa

SEQ ID NO: 9571 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
accattatggaaagtaatat

SEQ ID NO: 9572 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aatccttacacactgattgt

SEQ ID NO: 9573 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
tttaaaggatatggagaaaa

SEQ ID NO: 9574 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tcaaaagatataagtgttta

SEQ ID NO: 9575 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ttcaaaaatggacaaaagac

SEQ ID NO: 9576 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tgtaaactatgcatctgata

SEQ ID NO: 9577 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tagagtgaagagataaccta

SEQ ID NO: 9578 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
acagcaaggcaaacaatcaa

SEQ ID NO: 9579 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
caaaagcaaatatagacaaa

SEQ ID NO: 9580 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tgttctaggcaaggattttt

SEQ ID NO: 9581 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ttcatgatgttgttctaggc

SEQ ID NO: 9582 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aactgaatagccacatgcaa

SEQ ID NO: 9583 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
agtaaatggttctgggcaaa

SEQ ID NO: 9584 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
atctacacatatacagtcaa

SEQ ID NO: 9585 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
agacacacagagcaatacat

SEQ ID NO: 9586 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ataaagctatagtaaccaaa

SEQ ID NO: 9587 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gatattccatgttcatggat

SEQ ID NO: 9588 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
gggaaagatattccatgttc

SEQ ID NO: 9589 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aaaagtagtagatttcataa

SEQ ID NO: 9590 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
atgatctgatcttagatata

SEQ ID NO: 9591 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tccaagatctggaacaagat

SEQ ID NO: 9592 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aactttctatattatatcaa

SEQ ID NO: 9593 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gctcaactggaaatcgtccc

SEQ ID NO: 9594 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tccaaaaaaatcaaaaggaa

SEQ ID NO: 9595 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aggaccacatggcttcactg

SEQ ID NO: 9596 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
accaataatgagtaacaaga

SEQ ID NO: 9597 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aaaactcaaacagaccaata

SEQ ID NO: 9598 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
cctaaatttggatgcaactt

SEQ ID NO: 9599 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tttgaattgtttgcctaaat

SEQ ID NO: 9600 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
cctgttctggatcatatcct

SEQ ID NO: 9601 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ctttattacaaatgcctgtt

SEQ ID NO: 9602 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
cgtgatgaagatcagtgctt

SEQ ID NO: 9603 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aagtagctattggttacaga

SEQ ID NO: 9604 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
caattattataagtatggaa

SEQ ID NO: 9605 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgtacaattattataagta

SEQ ID NO: 9606 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aagaatgccactttttaaga

SEQ ID NO: 9607 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
cactaccttgggatatagtt

SEQ ID NO: 9608 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
ttaagtcttagccactacct

SEQ ID NO: 9609 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggatgagccaaagaggcaaa

SEQ ID NO: 9610 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tggttgtgtttgtgatgagc

SEQ ID NO: 9611 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
agttcccagagtcttgaact

SEQ ID NO: 9612 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tcatctcccacttgagttcc

SEQ ID NO: 9613 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tcataatcttcatctcccac

SEQ ID NO: 9614 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
acaaacctacctgaaaatat

SEQ ID NO: 9615 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
taagtcatgtagcatagtgt

SEQ ID NO: 9616 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gtatgcacaattaaatatac

SEQ ID NO: 9617 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tggttatatctatatgataa

SEQ ID NO: 9618 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gaaatctagtgccctataaa

SEQ ID NO: 9619 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ggtataaagccatgcagcta

SEQ ID NO: 9620 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
acttaataatttgtctcccc

SEQ ID NO: 9621 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gcttgtgacttatagctcaa

SEQ ID NO: 9622 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tataaaggcagagccatgtc

SEQ ID NO: 9623 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
cagttataaatctagagtta

SEQ ID NO: 9624 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gagttatacagttataaatc

SEQ ID NO: 9625 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tttattcacagttataaagc

SEQ ID NO: 9626 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aaattcttattcttagtatg

SEQ ID NO: 9627 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aagtcaatggctgacctttc

SEQ ID NO: 9628 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
attatttcttaacatttatg

SEQ ID NO: 9629 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
agttgctctcagaataaaac

SEQ ID NO: 9630 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gcctggcagacagttgctct

SEQ ID NO: 9631 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
actctacagatgtgggaccc

SEQ ID NO: 9632 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGAGT
tcatccctcgatatctatgg

SEQ ID NO: 9633 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttttccaagacggtaaagta

SEQ ID NO: 9634 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
aatgctctatatttaattga

SEQ ID NO: 9635 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ataaaatgctctatatttaa

SEQ ID NO: 9636 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ctgcactccagcttggacta

SEQ ID NO: 9637 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgctcaggaggctgaggcat

SEQ ID NO: 9638 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
acttggaaaacgagattata

SEQ ID NO: 9639 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttactaagactccaccctcc

SEQ ID NO: 9640 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ctagtgagtcaaggtatgta

SEQ ID NO: 9641 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
cccttacctgcatatttcta

SEQ ID NO: 9642 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
aaacaattttatacttcttc

SEQ ID NO: 9643 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ccctcctaatttctccccaa

SEQ ID NO: 9644 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
cgcagttgggtcagggttaa

SEQ ID NO: 9645 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
tacttaaatcgcagttgggt

SEQ ID NO: 9646 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tgttaatacttaaatcgcag

SEQ ID NO: 9647 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
aacactctccacactttgct

SEQ ID NO: 9648 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAAT
gcctggccatccccaaagtc

SEQ ID NO: 9649 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tccccagttgctgagattac

SEQ ID NO: 9650 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gatcctcctgcctccacctc

SEQ ID NO: 9651 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tctcactctgttgcccagtc

SEQ ID NO: 9652 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tttgcctaaaccatttcaag

SEQ ID NO: 9653 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tctccctccacagtgcctgt

SEQ ID NO: 9654 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tcttaacattgcatgtagtg

SEQ ID NO: 9655 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atattaacaattagtatgaa

SEQ ID NO: 9656 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
agtgaatacagcaaagtggt

SEQ ID NO: 9657 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
acttagcagtgattcggata

SEQ ID NO: 9658 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGGAT
ctgaggaacttagcagtgat

SEQ ID NO: 9659 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gggaatccgatttggaaaat

SEQ ID NO: 9660 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
gacagtgccaattgcacctg

SEQ ID NO: 9661 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
agataagacaagcagaagat

SEQ ID NO: 9662 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ttatgtgaaacaaaccttac

SEQ ID NO: 9663 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
gcagtgactagaattaaaaa

SEQ ID NO: 9664 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aacctccagattgcagtgac

SEQ ID NO: 9665 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
agtctagggatacagtgatg

SEQ ID NO: 9666 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gagtctgcaggggctagtct

SEQ ID NO: 9667 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gtatggctgaccctctgctg

SEQ ID NO: 9668 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
gctccccatggtaattcttc

SEQ ID NO: 9669 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
atgatgtaatgataatggtg

SEQ ID NO: 9670 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
atgaatgctaggagagtttt

SEQ ID NO: 9671 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
taatgatagatgaatgctag

SEQ ID NO: 9672 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gtaataaagagtaatgatag

SEQ ID NO: 9673 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
cctgtttctcacaggtaata

SEQ ID NO: 9674 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
attctagcacgcttcttgga

SEQ ID NO: 9675 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tcataatgccattattgcat

SEQ ID NO: 9676 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gaaataaaactttgcttcaa

SEQ ID NO: 9677 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
cattttttttttttacaatg

SEQ ID NO: 9678 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tcaatttccttttttgtttc

SEQ ID NO: 9679 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aggtatgaccaaaatgaggg

SEQ ID NO: 9680 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ttttaggtatgaccaaaatg

SEQ ID NO: 9681 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
attcccagacctccgacctc

SEQ ID NO: 9682 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gacaactattaaaccatttc

SEQ ID NO: 9683 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccattaatcaaaatgagact

SEQ ID NO: 9684 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGGGT
aaaaataagttttagtcagc

SEQ ID NO: 9685 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
cctgatatagccttccacat

SEQ ID NO: 9686 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tggaggaactaccaatatca

SEQ ID NO: 9687 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tggtgagtgtttcattcgtg

SEQ ID NO: 9688 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
aaaacagaggggatatattg

SEQ ID NO: 9689 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
gatttatagtaaaaaacaga

SEQ ID NO: 9690 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ttgatcatggacactggtgt

SEQ ID NO: 9691 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ttgaagtgggcctttgaaca

SEQ ID NO: 9692 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
atgcttctgacacttaaaga

SEQ ID NO: 9693 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tatcagacaaggaagaagtg

SEQ ID NO: 9694 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ggcattgtttaggtattatt

SEQ ID NO: 9695 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tccgtcgcctcccaaagtgc

SEQ ID NO: 9696 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
aattcttctgcctcagcctc

SEQ ID NO: 9697 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tctcgctttgttgcccaggc

SEQ ID NO: 9698 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tattttttttttttttgaga

SEQ ID NO: 9699 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
gtatttataagctcctatag

SEQ ID NO: 9700 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
cttacaaattccttccaata

SEQ ID NO: 9701 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ctgcacaaaaaatatacatc

SEQ ID NO: 9702 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ccttgtaaccaccataaaaa

SEQ ID NO: 9703 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gtaagtgccttcacttccca

SEQ ID NO: 9704 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
ctcatcaggtatccagaagg

SEQ ID NO: 9705 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcttacaagcaggagaaaat

SEQ ID NO: 9706 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
catagcaatctgcctacttt

SEQ ID NO: 9707 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tttacattacagtggcagag

SEQ ID NO: 9708 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
cataaactttattcaaacat

SEQ ID NO: 9709 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gtggttaaaataatcaaaag

SEQ ID NO: 9710 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
attgtgtggccctgggagct

SEQ ID NO: 9711 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gtaagactagcctctatagc

SEQ ID NO: 9712 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tctacaattattaattgcaa

SEQ ID NO: 9713 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ttccgcgtgctgtgtggaga

SEQ ID NO: 9714 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tgtgttccgcgtgctgtgtg

SEQ ID NO: 9715 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gctctttggtaagagctaca

SEQ ID NO: 9716 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
ctttatatttgcttttagct

SEQ ID NO: 9717 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
gaaaaataagaatattttag

SEQ ID NO: 9718 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aattgatgaaaatgaaaaat

SEQ ID NO: 9719 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aagtattagaaagtagaatt

SEQ ID NO: 9720 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tgtatgaaagtattagaaag

SEQ ID NO: 9721 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gattatatgttcataacttt

SEQ ID NO: 9722 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
agtaagaagcttgtggctta

SEQ ID NO: 9723 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tatagtacaataatttattt

SEQ ID NO: 9724 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
acttaaagaactaaaaccac

SEQ ID NO: 9725 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttttaaaaacttttgggaat

SEQ ID NO: 9726 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
cattatttttaaaaactttt

SEQ ID NO: 9727 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
gccattatattctataataa

SEQ ID NO: 9728 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gctctttctagcagatgtgg

SEQ ID NO: 9729 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgagtatttccaagtaggc

SEQ ID NO: 9730 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
actgattgccatggatccat

SEQ ID NO: 9731 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tggtattaaaactgattgcc

SEQ ID NO: 9732 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tttctcacttaggtctttac

SEQ ID NO: 9733 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttacaggactaagttagat

SEQ ID NO: 9734 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
tgctgataaatctttaaaga

SEQ ID NO: 9735 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
cttctgctgataaatcttta

SEQ ID NO: 9736 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agtcctttgataccagtatc

SEQ ID NO: 9737 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
tttcggtgttgcctttttaa

SEQ ID NO: 9738 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
cttgagtcaaagtgtaccca

SEQ ID NO: 9739 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
atcttctttggtcagattcc

SEQ ID NO: 9740 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
atagacctaaacatttccct

SEQ ID NO: 9741 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tgcatccctgtgaactcaga

SEQ ID NO: 9742 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGAT
ttctaattgttggtggagat

SEQ ID NO: 9743 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
atttatctttggaaaaaggc

SEQ ID NO: 9744 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tgtttttccccatgtgctcg

SEQ ID NO: 9745 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tgaagaccagaagttctttt

SEQ ID NO: 9746 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ttcataaaccatgaataact

SEQ ID NO: 9747 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
cttatgactcttcataaacc

SEQ ID NO: 9748 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ccagttcatttttagggcca

SEQ ID NO: 9749 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
caaaatgccagtttttgact

SEQ ID NO: 9750 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
cagtgctggtcacactaact

SEQ ID NO: 9751 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ccaattagtaaaattgatgc

SEQ ID NO: 9752 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gaactggacatagaagactc

SEQ ID NO: 9753 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ttcatttatcatattcttgg

SEQ ID NO: 9754 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
gaatgctgattctgcattat

SEQ ID NO: 9755 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
agagtcccaaagtcctgggt

SEQ ID NO: 9756 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
gtcctcagagtcccaaagtc

SEQ ID NO: 9757 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tagtgaagtgtttgggtcct

SEQ ID NO: 9758 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
acataatagtagtgaagtgt

SEQ ID NO: 9759 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
cacatattttcagaaaacct

SEQ ID NO: 9760 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
ctataaaaggttaccatctt

SEQ ID NO: 9761 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tttccatatgaatggatgtg

SEQ ID NO: 9762 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atccagaactttccatatga

SEQ ID NO: 9763 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gcatatccagaactttccat

SEQ ID NO: 9764 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gtcagatgaatctgcagcct

SEQ ID NO: 9765 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tttcatattttttatgtcag

SEQ ID NO: 9766 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ggaacaccacccaatgactg

SEQ ID NO: 9767 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
agtgtatctattttattgta

SEQ ID NO: 9768 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
atctggaattgctctccata

SEQ ID NO: 9769 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttgcacacaaattcttgatc

SEQ ID NO: 9770 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
cttttttctcccagaacttg

SEQ ID NO: 9771 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tgactgatttgtatctggtt

SEQ ID NO: 9772 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tataaaccttgtttcaatat

SEQ ID NO: 9773 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
cagcaagagttttttctgga

SEQ ID NO: 9774 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
cacctgtgaactattacagc

SEQ ID NO: 9775 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tatttctagttgcttggttc

SEQ ID NO: 9776 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tggtgtgaaatgtctatttc

SEQ ID NO: 9777 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ccccaggtcccacctggtcc

SEQ ID NO: 9778 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
ctaataagcaaagatagtca

SEQ ID NO: 9779 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
aaaacccacaaagacagatg

SEQ ID NO: 9780 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ttgtttttatgtgcttaaaa

SEQ ID NO: 9781 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
agataaccaatggatactga

SEQ ID NO: 9782 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aatgatggtaaagataacca

SEQ ID NO: 9783 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aggcacatgaaattcttagg

SEQ ID NO: 9784 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ccaacctcagacagagagca

SEQ ID NO: 9785 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
atctcctttcagaggatatg

SEQ ID NO: 9786 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gtagttcctatctcctttca

SEQ ID NO: 9787 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
atcttatacctacaatttat

SEQ ID NO: 9788 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttaattcctttaatcctcac

SEQ ID NO: 9789 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
actgtcacatgacaaactat

SEQ ID NO: 9790 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gtaattccagaaatttatca

SEQ ID NO: 9791 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
cactaattgttcctttcaaa

SEQ ID NO: 9792 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aataaatacacttgttatgc

SEQ ID NO: 9793 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
accaacatagtgttttaaat

SEQ ID NO: 9794 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
gtttgtgtatatatgtgtgt

SEQ ID NO: 9795 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gcagacaaacatgatagatc

SEQ ID NO: 9796 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tttttacagagatctctcaa

SEQ ID NO: 9797 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ctacaaaactagaggaatta

SEQ ID NO: 9798 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
agtgaaaactacaaaactag

SEQ ID NO: 9799 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ttaatgaagtttcttcattt

SEQ ID NO: 9800 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgagcatgttaaatttctg

SEQ ID NO: 9801 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ctgcaaggtatttttcatta

SEQ ID NO: 9802 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggccacacatatatttcaat

SEQ ID NO: 9803 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
gacaatgtagtatttcaagt

SEQ ID NO: 9804 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tttctcattcctggagtttc

SEQ ID NO: 9805 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
agtgagatctttctcattcc

SEQ ID NO: 9806 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGAGT
tacagcagttccaaaggtct

SEQ ID NO: 9807 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aaatatttcatctggagtct

SEQ ID NO: 9808 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tttttaaaaaatatttcatc

SEQ ID NO: 9809 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cttcttatcttgaaaaaatt

SEQ ID NO: 9810 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
cctattccaaggaatcttat

SEQ ID NO: 9811 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
cttaatatgtacctattcca

SEQ ID NO: 9812 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tcccatttctatgaagaaat

SEQ ID NO: 9813 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gatatcagtacagaaaatgc

SEQ ID NO: 9814 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGGAT
tctttagagaacaatttatg

SEQ ID NO: 9815 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gaagggccttctctggtctt

SEQ ID NO: 9816 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aagagatataggatctgaga

SEQ ID NO: 9817 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
caaaggcagaggaagagata

SEQ ID NO: 9818 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
agccacctgccctcaggcca

SEQ ID NO: 9819 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tggaagaagttttcttctca

SEQ ID NO: 9820 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atttacctggtcctgaaagg

SEQ ID NO: 9821 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aataatttacctggtcctga

SEQ ID NO: 9822 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atggagcagtaactctaggc

SEQ ID NO: 9823 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
agcaaaatgaatggcattaa

SEQ ID NO: 9824 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tataagttctgtgcagcaaa

SEQ ID NO: 9825 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggggattgatatataaaaag

SEQ ID NO: 9826 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
ccaatttttttgtgaagcct

SEQ ID NO: 9827 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ctgagctcttagtatgtaag

SEQ ID NO: 9828 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
atgagtcatataagcatgaa

SEQ ID NO: 9829 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tggacatgagtcatataagc

SEQ ID NO: 9830 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aaaggatttacaccctggac

SEQ ID NO: 9831 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tattgaactagatccttcca

SEQ ID NO: 9832 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
atatacacagtaaaaaaaga

SEQ ID NO: 9833 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
taaagagaccattcacacta

SEQ ID NO: 9834 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tttgaaagaccttatagttt

SEQ ID NO: 9835 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
agatgtacacaggtttccat

SEQ ID NO: 9836 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
agagaactcgggagaggata

SEQ ID NO: 9837 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tagggtaagagaactcggga

SEQ ID NO: 9838 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
tagagaaaaatgtcttattt

SEQ ID NO: 9839 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
taaatgtgtatcacccgagg

SEQ ID NO: 9840 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tgctgagaaattgtcgaaat

SEQ ID NO: 9841 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gaagaaacagaagaaagaaa

SEQ ID NO: 9842 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
gcagaattatgggcctctca

SEQ ID NO: 9843 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tatacaagtattaggagaag

SEQ ID NO: 9844 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ggcaattgcagcggcagcgg

SEQ ID NO: 9845 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tgtcctgtcctagggtttcc

SEQ ID NO: 9846 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
aggtgaaagatgtcctgtcc

SEQ ID NO: 9847 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGAGT
tgtcttattgcatggtttat

SEQ ID NO: 9848 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
gcctgattctattgatgata

SEQ ID NO: 9849 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
actcaatctttattaaacca

SEQ ID NO: 9850 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
gttatcccaggtactaccta

SEQ ID NO: 9851 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ataaacaaaacattttgtaa

SEQ ID NO: 9852 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttatttcccatgtttttac

SEQ ID NO: 9853 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaattatacatacatataaa

SEQ ID NO: 9854 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aaaaatcttttagaataatg

SEQ ID NO: 9855 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tatcatgaggaaaaatcttt

SEQ ID NO: 9856 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
cacctagttaaatctcttca

SEQ ID NO: 9857 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tcatgttttgttaatgtcac

SEQ ID NO: 9858 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
aattaacagatactcttcta

SEQ ID NO: 9859 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
atacacacaatggatttccc

SEQ ID NO: 9860 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tatatacacacatacacaca

SEQ ID NO: 9861 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tatcatgaggaaaaatcttt

SEQ ID NO: 9862 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gaaccaattctgggctgagc

SEQ ID NO: 9863 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ctccagctagattttcttta

SEQ ID NO: 9864 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agaagctaaacagaaagaat

SEQ ID NO: 9865 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
cattgaagaagctaaacaga

SEQ ID NO: 9866 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tactactacacttaataatc

SEQ ID NO: 9867 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tgagcaaaggatttaatttt

SEQ ID NO: 9868 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ctaaaatttgaaagtgagca

SEQ ID NO: 9869 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ttttaacagtaaaagggact

SEQ ID NO: 9870 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gatgataaagaaagaaaaga

SEQ ID NO: 9871 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
taattgaaaatacctatgag

SEQ ID NO: 9872 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ctaatgtaggtaacaggttg

SEQ ID NO: 9873 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
cggtggtggggggcaaaggg

SEQ ID NO: 9874 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aacaacgcatgttctcactc

SEQ ID NO: 9875 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ttcatgtcctttgcagggac

SEQ ID NO: 9876 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aatactatgcagccataaaa

SEQ ID NO: 9877 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aatgtggcacatatacacca

SEQ ID NO: 9878 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
aaatgcccatcaatgataga

SEQ ID NO: 9879 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
gtgacccagcaatcccatta

SEQ ID NO: 9880 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
aatgcttttaaactgttggt

SEQ ID NO: 9881 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tggagaaaatgtggagaaat

SEQ ID NO: 9882 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agataccatctcatgccagt

SEQ ID NO: 9883 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
caggtcttaaaacctagata

SEQ ID NO: 9884 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
acacacaccggggcctgttg

SEQ ID NO: 9885 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
gcatgttctcactcataagt

SEQ ID NO: 9886 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atcatgtcctttacagggac

SEQ ID NO: 9887 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atactatgcagccattaaaa

SEQ ID NO: 9888 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aatgtggtacatatacacca

SEQ ID NO: 9889 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tatttacaatagcaaagaga

SEQ ID NO: 9890 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGAAT
attactgggtatataccgaa

SEQ ID NO: 9891 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ttgacctagcaatcccatta

SEQ ID NO: 9892 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
agcacttttacactgttggt

SEQ ID NO: 9893 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
agataccatctcaagtcagt

SEQ ID NO: 9894 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
atcccatcaaaaagtgggca

SEQ ID NO: 9895 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tcattggttctgtttatgtg

SEQ ID NO: 9896 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
attgatagtttttaacatga

SEQ ID NO: 9897 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gtttattgatagtttttaac

SEQ ID NO: 9898 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
attcagtatgatattggcta

SEQ ID NO: 9899 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
gtcttgtgccagtttttaaa

SEQ ID NO: 9900 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccagaaattccaacactata

SEQ ID NO: 9901 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttgacttccggtcttcctat

SEQ ID NO: 9902 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
atgatcgggttttctaaata

SEQ ID NO: 9903 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGGGT
gagttttggggctgagatga

SEQ ID NO: 9904 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tgaagttgcttatcagttta

SEQ ID NO: 9905 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
cttgtctattgttggtgtat

SEQ ID NO: 9906 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tctttatagcaattgcaaat

SEQ ID NO: 9907 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ttgtgtcctctcttgtttcc

SEQ ID NO: 9908 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
attcttcctatccatgagta

SEQ ID NO: 9909 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
gacattgattcttcctatcc

SEQ ID NO: 9910 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gtaatttgatgggactagca

SEQ ID NO: 9911 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ccagctttgttctttttgct

SEQ ID NO: 9912 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ccattggcctatatgtctgt

SEQ ID NO: 9913 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ccagcaccatttattatata

SEQ ID NO: 9914 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
cattaagtctttaatccatc

SEQ ID NO: 9915 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
cttctagggttttcatggtt

SEQ ID NO: 9916 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
gtgttgcctaggttttcttc

SEQ ID NO: 9917 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tctttgcccatgcctatttc

SEQ ID NO: 9918 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
taatattagacctttgtcag

SEQ ID NO: 9919 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
atgcactttacagcaaaaat

SEQ ID NO: 9920 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tatttccgagaatattataa

SEQ ID NO: 9921 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tttatatttactttatttcc

SEQ ID NO: 9922 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
taacaatgattcacttttct

SEQ ID NO: 9923 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
atgtggctatttcctctaac

SEQ ID NO: 9924 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gactgttttccatgcgtgct

SEQ ID NO: 9925 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
ttcctgagtatatcatccca

SEQ ID NO: 9926 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tctctagatctctcgccttc

SEQ ID NO: 9927 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAAT
actaataatatgggtagttc

SEQ ID NO: 9928 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ttactcccatcactaataat

SEQ ID NO: 9929 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aggaggttttttatttattt

SEQ ID NO: 9930 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gagaaacatgcattgtattt

SEQ ID NO: 9931 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
gggaaaacctttaccaacag

SEQ ID NO: 9932 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
cgtgtgtagtcagtgtccag

SEQ ID NO: 9933 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gtccccctatagaagaaacc

SEQ ID NO: 9934 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
acagacagacttatgccttg

SEQ ID NO: 9935 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tattaaacactttctatgtg

SEQ ID NO: 9936 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tattgactctaatctattcc

SEQ ID NO: 9937 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tgctgttcccagaagaatct

SEQ ID NO: 9938 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gataaggttgctgttcccag

SEQ ID NO: 9939 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
actggcaacataggaataaa

SEQ ID NO: 9940 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tctgtgtacactggcaacat

SEQ ID NO: 9941 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttaagaatattgtatatat

SEQ ID NO: 9942 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gacttgggtacacatatttt

SEQ ID NO: 9943 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
agcaaagggattccttggac

SEQ ID NO: 9944 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gttttggccactctaagcaa

SEQ ID NO: 9945 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
taaatgtgactcataggtga

SEQ ID NO: 9946 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ggtcttctttctggaaaacg

SEQ ID NO: 9947 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
aaaactccaccaaaagttgg

SEQ ID NO: 9948 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAAT
gcaagactttgagacagtgc

SEQ ID NO: 9949 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaaggctgaaagagaaggaa

SEQ ID NO: 9950 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ttgtggtttcagcacagatt

SEQ ID NO: 9951 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
agaatatttttattacttgg

SEQ ID NO: 9952 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ctgttcaaattcttcttcaa

SEQ ID NO: 9953 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
catattgcctgggaccaggc

SEQ ID NO: 9954 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tatgagaaaatagtaaataa

SEQ ID NO: 9955 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttatcaataaatatttgagg

SEQ ID NO: 9956 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
cgtcctaatgatgcatttct

SEQ ID NO: 9957 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
aggtttgtataagtgcaccc

SEQ ID NO: 9958 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tataacagttgcctacaata

SEQ ID NO: 9959 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tccggagtattgtaccacat

SEQ ID NO: 9960 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
cttactgagtctgcctcttc

SEQ ID NO: 9961 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tcacttatgttactgcctta

SEQ ID NO: 9962 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tcctaagtaagtatggactg

SEQ ID NO: 9963 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
attgtcatctcctcaacacc

SEQ ID NO: 9964 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tactactaaaaattagcaca

SEQ ID NO: 9965 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gccttaacagcaaatgacag

SEQ ID NO: 9966 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
catttaaacatttactatac

SEQ ID NO: 9967 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aggaagtcaggttcttatag

SEQ ID NO: 9968 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
atcagattttttaatttgac

SEQ ID NO: 9969 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tagaagcaacattcaaatcc

SEQ ID NO: 9970 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gataattcacttacttaaga

SEQ ID NO: 9971 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
gagcagctagtacagaatgt

SEQ ID NO: 9972 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ctgtttttgagcagctagta

SEQ ID NO: 9973 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gcccatccttcccgaggttc

SEQ ID NO: 9974 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tccatccttattaaaatatt

SEQ ID NO: 9975 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tgtgaaccagcattagttta

SEQ ID NO: 9976 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tgtaaagttttctacaaacc

SEQ ID NO: 9977 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ctttcagaatcatcccactt

SEQ ID NO: 9978 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gtgattcattctttatcttt

SEQ ID NO: 9979 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
cggggtttcattgtgttagc

SEQ ID NO: 9980 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGGT
ttttgtatttttagtagaga

SEQ ID NO: 9981 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
ctcactgtaagctccgcctc

SEQ ID NO: 9982 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tctcactctgtcgcctaggc

SEQ ID NO: 9983 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttttttttttttttttgaga

SEQ ID NO: 9984 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tatacctagtagtgggatta

SEQ ID NO: 9985 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tctcagtatatacctagtag

SEQ ID NO: 9986 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
attcatcagttgatggacat

SEQ ID NO: 9987 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ctaatctactttctgtccct

SEQ ID NO: 9988 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ctcattttttaaactatact

SEQ ID NO: 9989 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttttaaaaataggtttattg

SEQ ID NO: 9990 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
attaatttaaaaacttcacc

SEQ ID NO: 9991 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gttgtctttctgagcaaggg

SEQ ID NO: 9992 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
tgcattatttgcccttcgtt

SEQ ID NO: 9993 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
atcccctgcactagttttct

SEQ ID NO: 9994 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gaactacatttgccagagtg

SEQ ID NO: 9995 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cttgtgagaactacatttgc

SEQ ID NO: 9996 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tattggccttcactactaac

SEQ ID NO: 9997 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
gtggttatattgggctaaaa

SEQ ID NO: 9998 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
tatgctgctacagatgaaag

SEQ ID NO: 9999 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tggcaatatttaaaagatca

SEQ ID NO: 10000 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atgagaaagtgctaaggcaa

SEQ ID NO: 10001 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ccatggatttaagctgtaca

SEQ ID NO: 10002 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
actgatgataatgaatgccc

SEQ ID NO: 10003 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
caggttaggcactgatgata

SEQ ID NO: 10004 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ataaccattcacttggttgt

SEQ ID NO: 10005 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
catgagaaatttagtgtatt

SEQ ID NO: 10006 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aattctacagatgatttgat

SEQ ID NO: 10007 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ataagatgggatcattgcct

SEQ ID NO: 10008 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tatttcctcaaagtataaga

SEQ ID NO: 10009 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gcagagttatcaaaagatga

SEQ ID NO: 10010 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
aaagatagaagagaagactg

SEQ ID NO: 10011 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tcaagtcctcgtgaaagtga

SEQ ID NO: 10012 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
taatgaatgagtagttatat

SEQ ID NO: 10013 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tgttttgctagtgataatga

SEQ ID NO: 10014 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tggatgttttgctagtgata

SEQ ID NO: 10015 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aaaaatatatgggtttttgt

SEQ ID NO: 10016 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
gctggcatttaaaaaaatat

SEQ ID NO: 10017 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aatttggctataaagggaag

SEQ ID NO: 10018 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
ggtaagaataaggtgcatac

SEQ ID NO: 10019 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
taagtggtagggttcaaggt

SEQ ID NO: 10020 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
gagaaaatttgggtaagtgg

SEQ ID NO: 10021 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
agagaatttcttgagaaaat

SEQ ID NO: 10022 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aagtaacagggaagtcatca

SEQ ID NO: 10023 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
atgctgcaagatcaaggagt

SEQ ID NO: 10024 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
agaatcatgctgcaagatca

SEQ ID NO: 10025 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tagaaacagatgtgcttgtg

SEQ ID NO: 10026 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agatctacaactctgacatt

SEQ ID NO: 10027 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ctgatatttttaagtagata

SEQ ID NO: 10028 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tatagaaatcagagggcctg

SEQ ID NO: 10029 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ccaggtggatatataatata

SEQ ID NO: 10030 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
gatgcctttgagatgtccag

SEQ ID NO: 10031 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tttctggctgcaataactgg

SEQ ID NO: 10032 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tcagtttctggctgcaataa

SEQ ID NO: 10033 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
taaagaagacaggaagcatt

SEQ ID NO: 10034 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aaagtctgtagagcttgctg

SEQ ID NO: 10035 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gagaaaataaaggtttcatc

SEQ ID NO: 10036 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
agcaagggtagatggtagat

SEQ ID NO: 10037 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
ttgtgcacaactgattgagc

SEQ ID NO: 10038 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ggacatttcagcccatggga

SEQ ID NO: 10039 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
gagaaagtagcagaaaaaat

SEQ ID NO: 10040 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gtggtttggtaagagaaagg

SEQ ID NO: 10041 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaagggagggtatgggttta

SEQ ID NO: 10042 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
gtcctgaataaagggagggt

SEQ ID NO: 10043 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
gcaaaggtcctgaataaagg

SEQ ID NO: 10044 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aaatagcatgggcaaaggtc

SEQ ID NO: 10045 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
tgggtgtgagtctatgtgtg

SEQ ID NO: 10046 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
aaaatagtttaagtgtgggt

SEQ ID NO: 10047 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
agccataaaatagtttaagt

SEQ ID NO: 10048 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
ataaatgccatgcaaaggaa

SEQ ID NO: 10049 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
cacagagcttatcatctagt

SEQ ID NO: 10050 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aagaggtgtttaaatcaagt

SEQ ID NO: 10051 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tgcatgacaattagctaata

SEQ ID NO: 10052 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tctttatattatatttaaac

SEQ ID NO: 10053 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
taatagagcccttgagttat

SEQ ID NO: 10054 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
taataataataatagagccc

SEQ ID NO: 10055 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tactcaggaggctgaggcag

SEQ ID NO: 10056 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
taatttaattcatcgctttc

SEQ ID NO: 10057 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
acaagaatatactaatagat

SEQ ID NO: 10058 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ctgagacagctacttgttac

SEQ ID NO: 10059 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
agtatttatagacagaaaaa

SEQ ID NO: 10060 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ctcaactcagcaacatgagc

SEQ ID NO: 10061 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
cctatttctgagtttatact

SEQ ID NO: 10062 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tctgagtcttgctcctattt

SEQ ID NO: 10063 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
ctgggatctgtccttttatt

SEQ ID NO: 10064 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
ttaaacttaagttttctcac

SEQ ID NO: 10065 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ctgtaaaattaatatatctg

SEQ ID NO: 10066 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaacttatttccaatggatg

SEQ ID NO: 10067 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tgatttgaaacttatttcca

SEQ ID NO: 10068 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttactaccaccatttgatg

SEQ ID NO: 10069 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
ggaaatgagggaggaaaggt

SEQ ID NO: 10070 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
atctatctgatggtgcccac

SEQ ID NO: 10071 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tgtactttctgtctgacacc

SEQ ID NO: 10072 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
actggaacggttgatgaata

SEQ ID NO: 10073 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gtctctcactggaacggttg

SEQ ID NO: 10074 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tttcttacataaagcatgaa

SEQ ID NO: 10075 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tagagtttcttacataaagc

SEQ ID NO: 10076 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
cttaattcagaagtatcaat

SEQ ID NO: 10077 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gatatcaaagtttagttcag

SEQ ID NO: 10078 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGAGT
catccactttgtaaccaatg

SEQ ID NO: 10079 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ctagagaaataaatgtagcc

SEQ ID NO: 10080 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ctaatttctatatcataaaa

SEQ ID NO: 10081 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
cagtactggcaaaaggaaca

SEQ ID NO: 10082 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
aaagctgctacagtgtgaat

SEQ ID NO: 10083 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
atatagaaagctgctacagt

SEQ ID NO: 10084 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gtgaagaagactttagaagt

SEQ ID NO: 10085 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
aaagcataatgaatacccta

SEQ ID NO: 10086 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atgaaacattagaaagcata

SEQ ID NO: 10087 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tgatcctgactgtgttctgt

SEQ ID NO: 10088 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gcaaacccagaaggcttttt

SEQ ID NO: 10089 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgacaacctaggtattcttt

SEQ ID NO: 10090 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaaattatttttaaagtggt

SEQ ID NO: 10091 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
gagatcataaatatcagcat

SEQ ID NO: 10092 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
tgaaatcttccctcctgtct

SEQ ID NO: 10093 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
attgcatgggtctttaggat

SEQ ID NO: 10094 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
taatcaattgcatgggtctt

SEQ ID NO: 10095 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ctttgagtttaatcaattgc

SEQ ID NO: 10096 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tcattatcaaaagtcaacct

SEQ ID NO: 10097 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
tcagtcattccaggtgagag

SEQ ID NO: 10098 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
caatttcagtcattccaggt

SEQ ID NO: 10099 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
gtctcagcattgagaacatt

SEQ ID NO: 10100 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cccctattacagatatgtga

SEQ ID NO: 10101 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
actcataactccaactattt

SEQ ID NO: 10102 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
gtttcagctcttcgaacttt

SEQ ID NO: 10103 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ttaattctacaggtatttaa

SEQ ID NO: 10104 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tcatagactctatctaaatt

SEQ ID NO: 10105 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ctgtattttgtttgcatcaa

SEQ ID NO: 10106 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttgtttacgcatttaagtgt

SEQ ID NO: 10107 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
gtctaaattaccataatgtt

SEQ ID NO: 10108 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttgtctatttggattttttt

SEQ ID NO: 10109 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
atctctatggatttgtctat

SEQ ID NO: 10110 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ctcatctatgttttatctct

SEQ ID NO: 10111 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
gagccacctagacaatacag

SEQ ID NO: 10112 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tctattttccgttaatgact

SEQ ID NO: 10113 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
caaatgtatttatcagaaaa

SEQ ID NO: 10114 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttccaagttcttgtttaaaa

SEQ ID NO: 10115 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
cctccatgctcagcacttgg

SEQ ID NO: 10116 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tcttcctccatgctcagcac

SEQ ID NO: 10117 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ggggtctgatttttccagca

SEQ ID NO: 10118 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
ttccaataacagcaaacctc

SEQ ID NO: 10119 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ttcgtgacccgtggaactgg

SEQ ID NO: 10120 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgcaagaggcttctgtgtag

SEQ ID NO: 10121 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttttactggaatatatactt

SEQ ID NO: 10122 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gtgtttaggtacacttttac

SEQ ID NO: 10123 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tttcacatctagtatcccaa

SEQ ID NO: 10124 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
atagacctattgtagtttaa

SEQ ID NO: 10125 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tattgacattttaatatttt

SEQ ID NO: 10126 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
ttcaagtacctctgctttct

SEQ ID NO: 10127 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gtgtatttttaaatgattgg

SEQ ID NO: 10128 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
atgggtgtatttttaaatga

SEQ ID NO: 10129 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ggtgtatgttttataattat

SEQ ID NO: 10130 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
atgttacacatattttattc

SEQ ID NO: 10131 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gatgctacagtgttttctca

SEQ ID NO: 10132 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ttactgcatttatgaagatg

SEQ ID NO: 10133 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
ggaccaaaaatgtcgagtaa

SEQ ID NO: 10134 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAGT
accggactggaccaaaaatg

SEQ ID NO: 10135 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
caaactgcatatttatgacc

SEQ ID NO: 10136 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aaatagtctacaagctcatt

SEQ ID NO: 10137 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
gagtggcaatattaagattt

SEQ ID NO: 10138 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tgggtctcagagaagactgg

SEQ ID NO: 10139 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tattattaatataatttgtc

SEQ ID NO: 10140 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tctcctttcagtcctctaag

SEQ ID NO: 10141 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tgatgtgaaaaattgatatt

SEQ ID NO: 10142 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tgacattggaaccacattgc

SEQ ID NO: 10143 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttactatgaagaagtggact

SEQ ID NO: 10144 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aaattgaactcagtgattgg

SEQ ID NO: 10145 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
attaccgtggttagtaagtg

SEQ ID NO: 10146 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aatggctacaataacatttc

SEQ ID NO: 10147 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gctatggaaaaggacactta

SEQ ID NO: 10148 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tggttgtttttatttcttaa

SEQ ID NO: 10149 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
caaccggagaaaaataaggc

SEQ ID NO: 10150 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ctgactcacagacttacctc

SEQ ID NO: 10151 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
aaataattttccatgtaaaa

SEQ ID NO: 10152 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ctactgagatttaagacaaa

SEQ ID NO: 10153 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tacaattgcagaaagaatgg

SEQ ID NO: 10154 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tcaatacaattgcagaaaga

SEQ ID NO: 10155 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
catgtcaatacaattgcaga

SEQ ID NO: 10156 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
aggtccctcccctgagacgt

SEQ ID NO: 10157 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gatttaatttactcactgtt

SEQ ID NO: 10158 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ctataaagaactacctgaga

SEQ ID NO: 10159 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
cggggattcaccgtgttagc

SEQ ID NO: 10160 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
tttgtatttttagtagagac

SEQ ID NO: 10161 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
cattctcccacctcagcctc

SEQ ID NO: 10162 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
ctcactgcaagctccgcctc

SEQ ID NO: 10163 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tctccctctgttgcccaggc

SEQ ID NO: 10164 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttttttttttttttttgaga

SEQ ID NO: 10165 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tcatttttctaggaagttcc

SEQ ID NO: 10166 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
atcacttaaaagtttttaat

SEQ ID NO: 10167 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tccttcacatcccttgtaag

SEQ ID NO: 10168 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
attcttcctacacatgagca

SEQ ID NO: 10169 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gtagcttgatggggatggca

SEQ ID NO: 10170 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
aaagtcattggtagcttgat

SEQ ID NO: 10171 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ccagctttgttcttttggct

SEQ ID NO: 10172 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tggtaccagtaccatgctgt

SEQ ID NO: 10173 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ccagcaccatttgttaaata

SEQ ID NO: 10174 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ttttgtataaggtgtaagga

SEQ ID NO: 10175 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gtttaagtctttaatccatc

SEQ ID NO: 10176 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
gtaatgcctgggttttcttc

SEQ ID NO: 10177 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tatgtcctgaatggtaatgc

SEQ ID NO: 10178 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tccttgcccatgcctatgtc

SEQ ID NO: 10179 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ggatattagccttttgtcag

SEQ ID NO: 10180 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
gtttgagttcattgtagatt

SEQ ID NO: 10181 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tttttttcttgtaaatttgt

SEQ ID NO: 10182 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
gtcctttgcccactttttga

SEQ ID NO: 10183 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttctagttctagatccctg

SEQ ID NO: 10184 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tatacccagtaatgggatgg

SEQ ID NO: 10185 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tttgggtatatacccagtaa

SEQ ID NO: 10186 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
gcagcatgatttatagtcct

SEQ ID NO: 10187 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ggttccaagtgtttgctatt

SEQ ID NO: 10188 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
agtctatcattgttggacat

SEQ ID NO: 10189 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tattcttgtgatagtttact

SEQ ID NO: 10190 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttcaattcccacctatgagt

SEQ ID NO: 10191 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tcattgttcaattcccacct

SEQ ID NO: 10192 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
ccccaccccaccacagtccc

SEQ ID NO: 10193 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
tttaattatactttaagttt

SEQ ID NO: 10194 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atatatatatataggatatt

SEQ ID NO: 10195 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tatatatatatatatatata

SEQ ID NO: 10196 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gtgaataaccatatcatgac

SEQ ID NO: 10197 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
attgagattagtgaaattta

SEQ ID NO: 10198 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
cctactatgcagacaaaaag

SEQ ID NO: 10199 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tgaagaggaattaaaatata

SEQ ID NO: 10200 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tcttatgtgaggagctgaag

SEQ ID NO: 10201 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
gaagcgtaaacttcaaattt

SEQ ID NO: 10202 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
taaatatagacgaaaagaag

SEQ ID NO: 10203 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tttaaaagaggaaagttgag

SEQ ID NO: 10204 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
agacttttaaaagaggaaag

SEQ ID NO: 10205 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ggtaaaacagcatcaggctg

SEQ ID NO: 10206 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tgaagtgacagcagaggatt

SEQ ID NO: 10207 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
acattgttgaagtgacagca

SEQ ID NO: 10208 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aagaaagtggtttcgtgaga

SEQ ID NO: 10209 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
cgcggtaacttgaatggatg

SEQ ID NO: 10210 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
gccatctcgcggtaacttga

SEQ ID NO: 10211 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tgctgccatctcgcggtaac

SEQ ID NO: 10212 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
gatggagcctaaaattgtga

SEQ ID NO: 10213 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ggtggaaatagcaagagaat

SEQ ID NO: 10214 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
agatgtggtggaaatagcaa

SEQ ID NO: 10215 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atgagttgattccaactctc

SEQ ID NO: 10216 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aacattaataggaaattgga

SEQ ID NO: 10217 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tacaaacattaataggaaat

SEQ ID NO: 10218 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
taaattgaaaatcttctgga

SEQ ID NO: 10219 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
catagatagtgattcctctg

SEQ ID NO: 10220 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
attctgtagcctatgggcca

SEQ ID NO: 10221 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tataaatagaacaacaaagc

SEQ ID NO: 10222 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aatcattcagaaaatctctt

SEQ ID NO: 10223 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aattatattatttaattatt

SEQ ID NO: 10224 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
atttatcgttcagaaaatct

SEQ ID NO: 10225 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
acaggctgactctcttgtta

SEQ ID NO: 10226 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gtctaacagccttctactag

SEQ ID NO: 10227 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
atctagctaagatcattgat

SEQ ID NO: 10228 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tgtgctactccagtgaacac

SEQ ID NO: 10229 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
actaagtacttagccaagtt

SEQ ID NO: 10230 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ccctaatgttcaagtaaagg

SEQ ID NO: 10231 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
tgttactgtggtaattgttt

SEQ ID NO: 10232 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ctttcagaatcatcctactt

SEQ ID NO: 10233 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ataacttactctttaccttt

SEQ ID NO: 10234 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
tgtaccaagtagtggaattg

SEQ ID NO: 10235 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
cttgagtctgtaccaagtag

SEQ ID NO: 10236 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
gacatatgttttaaattccc

SEQ ID NO: 10237 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gtgtttactttttggctagt

SEQ ID NO: 10238 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
ctttatccatttattcattg

SEQ ID NO: 10239 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gctaaatactaattcagtgt

SEQ ID NO: 10240 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGGT
tttggctctgtgttctttca

SEQ ID NO: 10241 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
attctggacatttcataaga

SEQ ID NO: 10242 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
atactctacattttgtttct

SEQ ID NO: 10243 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
caatcatcattatgtagttt

SEQ ID NO: 10244 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
aggacaattttcacatattt

SEQ ID NO: 10245 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tatgatttccaaaagtgttg

SEQ ID NO: 10246 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tggtaccctccagttgaatg

SEQ ID NO: 10247 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaagagatggtaccctccag

SEQ ID NO: 10248 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
atcaaactggtaatggacat

SEQ ID NO: 10249 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gaggagaataggaatattgg

SEQ ID NO: 10250 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
agacagagacagaggagaat

SEQ ID NO: 10251 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgggggagacagagacagag

SEQ ID NO: 10252 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
gctgtgttgagcatgtgcat

SEQ ID NO: 10253 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
agtttcacctctccaaacta

SEQ ID NO: 10254 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gtattcattttcacttttat

SEQ ID NO: 10255 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tattgtactttttttatttt

SEQ ID NO: 10256 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctgggcctcccaaagttc

SEQ ID NO: 10257 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ttttgtacttttagtagaga

SEQ ID NO: 10258 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ctcactgcaagctccgcctc

SEQ ID NO: 10259 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tctcgctctattgcccaggc

SEQ ID NO: 10260 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
ctttatttatttatttgaga

SEQ ID NO: 10261 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGAAT
aaaattatttggcaatataa

SEQ ID NO: 10262 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gacacctgagattactgtct

SEQ ID NO: 10263 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
taacccttactgttaggatt

SEQ ID NO: 10264 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tttagtgtaacccttactgt

SEQ ID NO: 10265 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
catctatctgtgtgtataac

SEQ ID NO: 10266 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
caaagtatattttctttctt

SEQ ID NO: 10267 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aattgtaaattaaacatgac

SEQ ID NO: 10268 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
actgcctttatatgcaacat

SEQ ID NO: 10269 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
taatatgagattaatggtga

SEQ ID NO: 10270 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
tctctaatatgagattaatg

SEQ ID NO: 10271 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ctataggaaatcttagatac

SEQ ID NO: 10272 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atagaaaataagaaagagtt

SEQ ID NO: 10273 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tgcatacatagaaaataaga

SEQ ID NO: 10274 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ggacagacatagatccatag

SEQ ID NO: 10275 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
cagagagtgtgataaacaca

SEQ ID NO: 10276 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
caatggaaatttgaaggcca

SEQ ID NO: 10277 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ttctgctttgatctcctcac

SEQ ID NO: 10278 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
agaaattctaacattctcag

SEQ ID NO: 10279 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
cattattgaataaataatcc

SEQ ID NO: 10280 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
caatgttttctgcaacatta

SEQ ID NO: 10281 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
aaaatggacatggataccct

SEQ ID NO: 10282 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tggttctagctaaaatggac

SEQ ID NO: 10283 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tatggatgaggagtagataa

SEQ ID NO: 10284 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
cattttaggatgtatggatg

SEQ ID NO: 10285 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
caggctacattttaggatgt

SEQ ID NO: 10286 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ctgacaggcaggctacattt

SEQ ID NO: 10287 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
caaatcctctcttgaaagag

SEQ ID NO: 10288 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ctgtctcctcaaatttctct

SEQ ID NO: 10289 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
cacaaagcatgacctttacc

SEQ ID NO: 10290 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
attctggtaaagtgcccctt

SEQ ID NO: 10291 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
atagaacgtttctagcacct

SEQ ID NO: 10292 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tgagactaatgtcgaacaac

SEQ ID NO: 10293 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ttttagcttgatgactcttg

SEQ ID NO: 10294 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttaatgctctaaactttcac

SEQ ID NO: 10295 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gataataggttgtctgataa

SEQ ID NO: 10296 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
agataaaaaggagttaaatt

SEQ ID NO: 10297 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
cttaaaaaaaaaagataaaa

SEQ ID NO: 10298 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gttcaagttcatgcctcatt

SEQ ID NO: 10299 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
gaagaacacatcaaactcaa

SEQ ID NO: 10300 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aacatggtttgatctagagg

SEQ ID NO: 10301 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
actgccttcaatgtaagata

SEQ ID NO: 10302 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
cttgttacttaaactttagc

SEQ ID NO: 10303 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gttggatttatacctttaaa

SEQ ID NO: 10304 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tttctaagtaattctatggg

SEQ ID NO: 10305 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
tttcatttctaagtaattct

SEQ ID NO: 10306 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aactttctaatttgaaaatg

SEQ ID NO: 10307 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ccctttaaagccattatcta

SEQ ID NO: 10308 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tatatggtgtttgaaaggtg

SEQ ID NO: 10309 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aagaagaaatattaataaaa

SEQ ID NO: 10310 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
acacaatctttactgtaact

SEQ ID NO: 10311 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
catctcaaagctcactatgg

SEQ ID NO: 10312 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
taaaacattaattttgtgtt

SEQ ID NO: 10313 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
cattacctaacataagtgaa

SEQ ID NO: 10314 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
accctggtcaatagccacag

SEQ ID NO: 10315 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
tgatttaacaaaatcaaatg

SEQ ID NO: 10316 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
attgaattttttctctcctt

SEQ ID NO: 10317 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaacttttctactttttgaa

SEQ ID NO: 10318 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tccaaaaacttttctacttt

SEQ ID NO: 10319 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
actgtgcctggtctattgaa

SEQ ID NO: 10320 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gagccactgtgcctggtcta

SEQ ID NO: 10321 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gccttggcctccgaaaatgt

SEQ ID NO: 10322 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ttttgtacttttcctagaga

SEQ ID NO: 10323 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ttttttttttttttttgaga

SEQ ID NO: 10324 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
caaaatatgtgttgtttcta

SEQ ID NO: 10325 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
aattgaacataatagagact

SEQ ID NO: 10326 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgaatgatgcttaaaatgtt

SEQ ID NO: 10327 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aatgaagtgatataagtgac

SEQ ID NO: 10328 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
agattttgccaggctataat

SEQ ID NO: 10329 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
caaaagaacttggagagaat

SEQ ID NO: 10330 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
atgcctcaaaagaacttgga

SEQ ID NO: 10331 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
gtttggaggatgagggatga

SEQ ID NO: 10332 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
acaggtttggaggatgaggg

SEQ ID NO: 10333 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gctgacaggtttggaggatg

SEQ ID NO: 10334 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ctttagagctgacaggtttg

SEQ ID NO: 10335 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tgcttgacaacagattgact

SEQ ID NO: 10336 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
cttgattattttacagcatc

SEQ ID NO: 10337 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
agtatctttgtcctttcttt

SEQ ID NO: 10338 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
aggattttattcattttaca

SEQ ID NO: 10339 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
atatattgtaactgttgctg

SEQ ID NO: 10340 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ccagtgtgaattgttctgta

SEQ ID NO: 10341 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tgtgagccactgaaaccagt

SEQ ID NO: 10342 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
gagaggttatgtcatctcca

SEQ ID NO: 10343 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttaactcaatttttcaaact

SEQ ID NO: 10344 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttaataatcttatgagctcc

SEQ ID NO: 10345 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aaagcaaggaattaaaatag

SEQ ID NO: 10346 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tgataaaattatccaaagca

SEQ ID NO: 10347 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gatcatttagctagtaagta

SEQ ID NO: 10348 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
aatcagaaaagttgcttaac

SEQ ID NO: 10349 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cctaaatgcctcaacatttt

SEQ ID NO: 10350 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gagcaatcaacagtcattct

SEQ ID NO: 10351 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
aacaacaaaggtgaaatgat

SEQ ID NO: 10352 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
accctgttcagcaatattca

SEQ ID NO: 10353 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tcagaagataaaccaagtgt

SEQ ID NO: 10354 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
atatttctttgcttgaagga

SEQ ID NO: 10355 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tcagagccataccaggcaca

SEQ ID NO: 10356 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tgcttccaatatttgacttc

SEQ ID NO: 10357 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
aagggttttcatagtacctt

SEQ ID NO: 10358 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
ctatagattttccctatgtg

SEQ ID NO: 10359 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tttacttcagtgatttttta

SEQ ID NO: 10360 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
atcatttgggaactgcagtt

SEQ ID NO: 10361 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
atactctaactgagccacaa

SEQ ID NO: 10362 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tatctgggagatatttttaa

SEQ ID NO: 10363 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aaaggaaacatactgtttaa

SEQ ID NO: 10364 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
ctccttgaaataagaaaata

SEQ ID NO: 10365 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aaaacagcctgaaattatta

SEQ ID NO: 10366 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
acaggtaagaggctcagtga

SEQ ID NO: 10367 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
aattctcctgcctcagcctc

SEQ ID NO: 10368 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ctcactgcaacctctgcctg

SEQ ID NO: 10369 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tcccgctctctggttcaggc

SEQ ID NO: 10370 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
atttatttatttatttgaga

SEQ ID NO: 10371 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttctgattctatggtgcctt

SEQ ID NO: 10372 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atcaatggtacacattgtca

SEQ ID NO: 10373 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aggtattttgtagaatgttc

SEQ ID NO: 10374 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
agtataggttaggtattttg

SEQ ID NO: 10375 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
tgatgatgttgatactttga

SEQ ID NO: 10376 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
tttttgatgatgttgatact

SEQ ID NO: 10377 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
acaaatgcccttaccctatt

SEQ ID NO: 10378 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttttgcttaaacttttgtct

SEQ ID NO: 10379 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttattacctttatttaatat

SEQ ID NO: 10380 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aaaactgatcagcatttcta

SEQ ID NO: 10381 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
taagctcattcctgacccag

SEQ ID NO: 10382 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
agtatgcttaccatggttga

SEQ ID NO: 10383 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
accttaacggcatcattaag

SEQ ID NO: 10384 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
gctcagtaaaatgagaatct

SEQ ID NO: 10385 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgttcagagctcagtaaaat

SEQ ID NO: 10386 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttaagcgtatccttgtcagc

SEQ ID NO: 10387 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
gggcttttgtagttataaac

SEQ ID NO: 10388 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ggtgatgttatcgaacatag

SEQ ID NO: 10389 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atcatgggaagtcttatgtt

SEQ ID NO: 10390 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tttcatgggagaaggcctat

SEQ ID NO: 10391 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cttggtgccaagacatagaa

SEQ ID NO: 10392 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tttatcttgttattgacata

SEQ ID NO: 10393 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aattgtacttcttattgtct

SEQ ID NO: 10394 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aattcaaggagcacatagga

SEQ ID NO: 10395 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttataattcaaggagcacat

SEQ ID NO: 10396 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ataagtgtaaccctgacagc

SEQ ID NO: 10397 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tgtagacatcctgccaagga

SEQ ID NO: 10398 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aatgctgtagacatcctgcc

SEQ ID NO: 10399 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tcctatttggctatttctcc

SEQ ID NO: 10400 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tatgaggtggtgccaggacc

SEQ ID NO: 10401 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ctttgataaagaatagtcag

SEQ ID NO: 10402 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aactatggcttactttgata

SEQ ID NO: 10403 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
gatgttatttaagcaaagtg

SEQ ID NO: 10404 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tctcaagctccaagactccc

SEQ ID NO: 10405 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
agtcaagaacctttagttat

SEQ ID NO: 10406 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggggtttcacagacctttca

SEQ ID NO: 10407 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
gaaaatgaaaagttttgtca

SEQ ID NO: 10408 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
actgcaacctgggcaacaga

SEQ ID NO: 10409 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttgcactgcaacctgggcaa

SEQ ID NO: 10410 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gggaggtcgcttgagtgcac

SEQ ID NO: 10411 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ttgggaaggtgggaggtcgc

SEQ ID NO: 10412 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
agggcagatcacttgagccc

SEQ ID NO: 10413 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gtaagataaaacaagataag

SEQ ID NO: 10414 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tactgaatctagactagggg

SEQ ID NO: 10415 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aattacaaccattgttttta

SEQ ID NO: 10416 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gaggtgttgtagtgaggaaa

SEQ ID NO: 10417 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
atcagggctagaggtctggg

SEQ ID NO: 10418 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
atgagatgtgaaggacatct

SEQ ID NO: 10419 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atagttaaattgtgacacag

SEQ ID NO: 10420 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ggctaaagatacactgcttg

SEQ ID NO: 10421 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tttcactctctctaatgttc

SEQ ID NO: 10422 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aacacagaattccttcactc

SEQ ID NO: 10423 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ccaatactgggatgaaaaca

SEQ ID NO: 10424 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
acaaaccatgtaaccaatac

SEQ ID NO: 10425 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tatcctaaaaatatagtttg

SEQ ID NO: 10426 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
atgagtactaggtctaatac

SEQ ID NO: 10427 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
aagatcaggaaaaataacca

SEQ ID NO: 10428 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
ggaacctttcaaatacagta

SEQ ID NO: 10429 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
caatgattaattctctcaac

SEQ ID NO: 10430 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gtagtcatttttcacctttg

SEQ ID NO: 10431 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ttcatatacaaataatggta

SEQ ID NO: 10432 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
attgtacattaagggaattc

SEQ ID NO: 10433 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
tatactatattgtacattaa

SEQ ID NO: 10434 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
ttattttcataacttgctgc

SEQ ID NO: 10435 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aaatgaaatgaacctattaa

SEQ ID NO: 10436 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gtattttaaaatatctgttg

SEQ ID NO: 10437 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
aacaataacaaacaacaaaa

SEQ ID NO: 10438 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gactgtaagccctagaggac

SEQ ID NO: 10439 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aaactgttaacacaagaggg

SEQ ID NO: 10440 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
aaaaatgaaggagacagctc

SEQ ID NO: 10441 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ttttcttgtttggaaaagtt

SEQ ID NO: 10442 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
gtacaggaatagaaaatcta

SEQ ID NO: 10443 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttgaagactagacaagtac

SEQ ID NO: 10444 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
catcctttaaaatttttaat

SEQ ID NO: 10445 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cttgaggttaaaaaaatctg

SEQ ID NO: 10446 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ataacaattggccacaaact

SEQ ID NO: 10447 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
acaggtagagtggcagagaa

SEQ ID NO: 10448 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
gaaaaacaggtagagtggca

SEQ ID NO: 10449 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gcatgggaatgaaaaacagg

SEQ ID NO: 10450 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ttataatggttgctaagcat

SEQ ID NO: 10451 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttagatgtatttacaacaac

SEQ ID NO: 10452 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aaatgtctggtaatatacac

SEQ ID NO: 10453 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tccaagaaggttggggactg

SEQ ID NO: 10454 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
taatgcctgatcatctgaag

SEQ ID NO: 10455 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tattgtgaactgcacatacg

SEQ ID NO: 10456 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
agcccagtgaacattaccac

SEQ ID NO: 10457 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
aggccacagtgggttagatc

SEQ ID NO: 10458 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
ggatctgtttataggccaca

SEQ ID NO: 10459 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
aagccacagatccataaaac

SEQ ID NO: 10460 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ggagtaaattaataaaattt

SEQ ID NO: 10461 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
agtcctaaagaaatgtgtta

SEQ ID NO: 10462 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaagtaaagggaagatcaaa

SEQ ID NO: 10463 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
agagtatataagattagctt

SEQ ID NO: 10464 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gtggttgggtgttgtcgatt

SEQ ID NO: 10465 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
ggatattgataacagagtgg

SEQ ID NO: 10466 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tacattgaggatattgataa

SEQ ID NO: 10467 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tcttcatacatcactacatt

SEQ ID NO: 10468 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
aatatgttgaggaaaaatat

SEQ ID NO: 10469 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tataaagaagagtgaatcat

SEQ ID NO: 10470 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
aatccagtttataaagaaga

SEQ ID NO: 10471 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
taataatccagtttataaag

SEQ ID NO: 10472 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tagcactattaaataaattc

SEQ ID NO: 10473 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gaatatgaaacaaaagttac

SEQ ID NO: 10474 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aagtagtgatggaaagttag

SEQ ID NO: 10475 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ataagaaggaagattggata

SEQ ID NO: 10476 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
attctagataagaaggaaga

SEQ ID NO: 10477 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ccacggcaggtgtcaaggct

SEQ ID NO: 10478 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
accacttaaaataacaggag

SEQ ID NO: 10479 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gcctcaccacttaaaataac

SEQ ID NO: 10480 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
taaagggcaacagaatccat

SEQ ID NO: 10481 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aagttcaaagtaaagggcaa

SEQ ID NO: 10482 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
tgtacatagacccagcacaa

SEQ ID NO: 10483 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tactggtcactgctgccaca

SEQ ID NO: 10484 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tggagatttattggaagttg

SEQ ID NO: 10485 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atgataggaacaatattgaa

SEQ ID NO: 10486 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
caaaataaaagttttggact

SEQ ID NO: 10487 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
aagcagtgtgtatatttaaa

SEQ ID NO: 10488 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tgatttcatttttaaaaact

SEQ ID NO: 10489 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aatttaattttaaaatattt

SEQ ID NO: 10490 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ttcttaaaataaatatattc

SEQ ID NO: 10491 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aactccacctggaggtaggg

SEQ ID NO: 10492 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aaaacatttccatttatggt

SEQ ID NO: 10493 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gaacataggctttaactata

SEQ ID NO: 10494 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
gaatggagaaaagagaaaat

SEQ ID NO: 10495 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gatgttctcattaatgaatg

SEQ ID NO: 10496 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
acttcacgatgttctcatta

SEQ ID NO: 10497 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tttagcaaaagagtaagtcc

SEQ ID NO: 10498 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ggtattgtgttctttagcaa

SEQ ID NO: 10499 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
aattatatgcactcaaagaa

SEQ ID NO: 10500 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gaaatgtattttatcccttg

SEQ ID NO: 10501 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
taattatttttacatttgtc

SEQ ID NO: 10502 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
gggaaaaagtccgtattgaa

SEQ ID NO: 10503 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
ttgaatgtattaaagataaa

SEQ ID NO: 10504 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccattgcttacaaagagttg

SEQ ID NO: 10505 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gatgccctccattgcttaca

SEQ ID NO: 10506 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
aggattatgcaatttgaaag

SEQ ID NO: 10507 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
cattccatatcttttagcaa

SEQ ID NO: 10508 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ctgacttttaaaataaccca

SEQ ID NO: 10509 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tctttaatagatgcagttga

SEQ ID NO: 10510 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ctgttcagactctactaatg

SEQ ID NO: 10511 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ggtaatacaaatataaattg

SEQ ID NO: 10512 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ttgttgcagagaccctatga

SEQ ID NO: 10513 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tattgtaacacgccttccag

SEQ ID NO: 10514 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tacttttttatggcatagcc

SEQ ID NO: 10515 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tctactgccgtaataaaaat

SEQ ID NO: 10516 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttaagctcacatgacttaat

SEQ ID NO: 10517 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
atattgaaaatggtgaaaac

SEQ ID NO: 10518 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tgtgataaattttatgaaca

SEQ ID NO: 10519 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
aaattcaatcttttcaattc

SEQ ID NO: 10520 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
ttagttatgagtttgtacct

SEQ ID NO: 10521 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
actcttgtttatgtttagtt

SEQ ID NO: 10522 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
actaacacagctggaagtcc

SEQ ID NO: 10523 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atcattatttatcattaact

SEQ ID NO: 10524 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tttcatattcaagaaaggaa

SEQ ID NO: 10525 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
attgtccctcagtatcagtg

SEQ ID NO: 10526 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaatgtttacctctacaaat

SEQ ID NO: 10527 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tccatgttcccatgagggag

SEQ ID NO: 10528 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tggtggatatattggaagcc

SEQ ID NO: 10529 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
acagttagtgattagccttg

SEQ ID NO: 10530 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gcttaatcactggatgacac

SEQ ID NO: 10531 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
caaagcttagagcttaatca

SEQ ID NO: 10532 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tttattaagtgtactataaa

SEQ ID NO: 10533 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
aatgagttagtgtcaatgcc

SEQ ID NO: 10534 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
taatcagtcaatattttcca

SEQ ID NO: 10535 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAGT
ccctctagactatgtgaaaa

SEQ ID NO: 10536 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
ctcatctcacttctggaatc

SEQ ID NO: 10537 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttggatgctcatctcacttc

SEQ ID NO: 10538 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tcagatacctgaaagtaatc

SEQ ID NO: 10539 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttcctctcataagaaatcac

SEQ ID NO: 10540 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
caaacacaggatgtccaaaa

SEQ ID NO: 10541 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tctcccaggcatctcaaaca

SEQ ID NO: 10542 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
cagcctcccattttaagttc

SEQ ID NO: 10543 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
accattagcctcttgggact

SEQ ID NO: 10544 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
catacgaccatatccatctg

SEQ ID NO: 10545 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tagcttttcagtgttggagt

SEQ ID NO: 10546 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
gtgacctagcttttcagtgt

SEQ ID NO: 10547 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ttttcatactcattttaccg

SEQ ID NO: 10548 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tattggttcaagtatgattc

SEQ ID NO: 10549 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aacaataatagaggtatgta

SEQ ID NO: 10550 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tttctctcttgtatcctggg

SEQ ID NO: 10551 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgaaaagactcccatacaag

SEQ ID NO: 10552 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
gcatagatatgctttgctgc

SEQ ID NO: 10553 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
ttgcagttgttacaattgat

SEQ ID NO: 10554 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
gtgggcatgtccctttcata

SEQ ID NO: 10555 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
ataagccctaaatcaatgcc

SEQ ID NO: 10556 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
aagtggggcagggggtacaa

SEQ ID NO: 10557 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
acattataggaagtggggca

SEQ ID NO: 10558 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
acgctttagtttccttagtt

SEQ ID NO: 10559 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tttttttctatactggcctg

SEQ ID NO: 10560 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
agtctgctgaataaagccaa

SEQ ID NO: 10561 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aatttctaaactcaagtctg

SEQ ID NO: 10562 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccagataaactactcactga

SEQ ID NO: 10563 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
cttttttcaattaacttcct

SEQ ID NO: 10564 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ctgtgatacattatatatca

SEQ ID NO: 10565 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
aattcattatagttaacaga

SEQ ID NO: 10566 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tatcatttattggggtgaaa

SEQ ID NO: 10567 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
agatgcttgatatcatttat

SEQ ID NO: 10568 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tatgctacctctctagatag

SEQ ID NO: 10569 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tcatttactcaggttcatac

SEQ ID NO: 10570 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
gttttcaagctgtaatactg

SEQ ID NO: 10571 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
aattataaattataaaattt

SEQ ID NO: 10572 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tagtagttgagaaagtaaaa

SEQ ID NO: 10573 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttttaaaaaattcaaaaacc

SEQ ID NO: 10574 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
atgcactactgcactacagc

SEQ ID NO: 10575 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggctgaggtgggagggtcac

SEQ ID NO: 10576 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
tacttgagaggctgaggtgg

SEQ ID NO: 10577 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
aaaaaatagacaaaacttag

SEQ ID NO: 10578 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tgggtggatcacttgagccc

SEQ ID NO: 10579 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
actttgggaggctgaggtgg

SEQ ID NO: 10580 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
cagcactttgggaggctgag

SEQ ID NO: 10581 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gcagttataaaaataaaata

SEQ ID NO: 10582 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tagatatgtctaagttattc

SEQ ID NO: 10583 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
cctttggtaagaaaaatgaa

SEQ ID NO: 10584 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ctcttagcagtgtctctttg

SEQ ID NO: 10585 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tcccacagcaactgtgaact

SEQ ID NO: 10586 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
aaatctcccagactttgtaa

SEQ ID NO: 10587 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agattaatgttattgatgaa

SEQ ID NO: 10588 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
cgaaacctttcttgtatttc

SEQ ID NO: 10589 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
caaaacaatataagagagat

SEQ ID NO: 10590 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
gttgaccattggcacattga

SEQ ID NO: 10591 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tgtttgtaacacttaattat

SEQ ID NO: 10592 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
attgctattattgagctggt

SEQ ID NO: 10593 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ataatctgtggtttccaaag

SEQ ID NO: 10594 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tctccagggaagctttggtg

SEQ ID NO: 10595 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
atggacagggacatgtttgc

SEQ ID NO: 10596 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
cgtttttgcagcatgaaggt

SEQ ID NO: 10597 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttcaattaatctgatgttga

SEQ ID NO: 10598 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aattagtgtaattatttcat

SEQ ID NO: 10599 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttttgaaataaaacattgat

SEQ ID NO: 10600 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tgtaaagtctcctaaaagct

SEQ ID NO: 10601 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cttgactttgagatgatgta

SEQ ID NO: 10602 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
ccctcggcctcccaaagtgc

SEQ ID NO: 10603 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aaacatcctgtctcagcctc

SEQ ID NO: 10604 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
atctcactctgtctcccagg

SEQ ID NO: 10605 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
cacaataatataatgaagat

SEQ ID NO: 10606 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
attttgagatttaatatgta

SEQ ID NO: 10607 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aatctgttatctcacaagta

SEQ ID NO: 10608 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tactgtaactaaagcaaagt

SEQ ID NO: 10609 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
gctagtttagtttagttgat

SEQ ID NO: 10610 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGAAT
cttgaaggactattttctaa

SEQ ID NO: 10611 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGGAT
aaggttaaacaattctaatg

SEQ ID NO: 10612 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tataatgatgatttatagag

SEQ ID NO: 10613 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
acacaagatctaacatgctg

SEQ ID NO: 10614 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ttccagaaaagagacatgaa

SEQ ID NO: 10615 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tttctttccctgtttgcaca

SEQ ID NO: 10616 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
gccttctcctcccacatatt

SEQ ID NO: 10617 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gctgcttcacatcaggggca

SEQ ID NO: 10618 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
attttaactcctggagtaat

SEQ ID NO: 10619 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ggctgtaatattttaactcc

SEQ ID NO: 10620 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tttttttgctacccttccac

SEQ ID NO: 10621 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
agagattctgtgaaagaaca

SEQ ID NO: 10622 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
aaaaaattacatttgtagca

SEQ ID NO: 10623 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
aactctccatgaattaaaat

SEQ ID NO: 10624 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
atgaacatctgtaactctcc

SEQ ID NO: 10625 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGGAT
ggtgaaagttttcaaaagag

SEQ ID NO: 10626 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
ataaataccttcatcttcaa

SEQ ID NO: 10627 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
atcgttagaagatattctct

SEQ ID NO: 10628 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atttagtagccattttagtg

SEQ ID NO: 10629 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tcaaaagcccagaggagcag

SEQ ID NO: 10630 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
attgattaaggcaggggaaa

SEQ ID NO: 10631 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgatctttgctattgcatt

SEQ ID NO: 10632 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
acattttctactggacagta

SEQ ID NO: 10633 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
aatgtgcttggttttgttgt

SEQ ID NO: 10634 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
atttgaaatatccatctctt

SEQ ID NO: 10635 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tggagaaatgggacagacac

SEQ ID NO: 10636 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gaatgggctataaagacggc

SEQ ID NO: 10637 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gaataagaagaaagagagag

SEQ ID NO: 10638 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaaaataaaagatcccaaag

SEQ ID NO: 10639 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
gtaggtgtaattggaaacaa

SEQ ID NO: 10640 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
agcaatgattcatgaaccct

SEQ ID NO: 10641 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tctgcatgaaaacctatccc

SEQ ID NO: 10642 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
cactaggcatgttgatctcc

SEQ ID NO: 10643 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
caaggctttcctccccaacc

SEQ ID NO: 10644 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttattactcaggaaaaatga

SEQ ID NO: 10645 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
ccaggtaatttagacacttc

SEQ ID NO: 10646 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tgggttacgattggctacca

SEQ ID NO: 10647 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
aatgcctgtgaagaatgggg

SEQ ID NO: 10648 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atgaactttaaatgcctgtg

SEQ ID NO: 10649 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttattatacaagttctagat

SEQ ID NO: 10650 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgtaggtcctggacttatc

SEQ ID NO: 10651 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
taactaattttcattggctc

SEQ ID NO: 10652 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aataagagtatatgaaaaat

SEQ ID NO: 10653 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ttaaatgagcgggttaaaat

SEQ ID NO: 10654 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GCGGGT
actggcaatcatttaaatga

SEQ ID NO: 10655 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tactctattctgagttccca

SEQ ID NO: 10656 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
tgattagatgttactctatt

SEQ ID NO: 10657 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
aaaagcaaagggaaagggtt

SEQ ID NO: 10658 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
aaagagaaaaagcaaaggga

SEQ ID NO: 10659 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ttctgtggataagacaaaat

SEQ ID NO: 10660 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ctgacagtactatatattct

SEQ ID NO: 10661 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
accacttaggacaggccctt

SEQ ID NO: 10662 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tcctagataggtgggtggga

SEQ ID NO: 10663 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
tgagtcctagataggtgggt

SEQ ID NO: 10664 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
ggatcttgagtcctagatag

SEQ ID NO: 10665 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
atagccacctatctaggatc

SEQ ID NO: 10666 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ttggagcatagccacctatc

SEQ ID NO: 10667 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
cttggactggctcctgaggg

SEQ ID NO: 10668 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
acctctgcctcccaaagtgt

SEQ ID NO: 10669 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tgtattttttttagtagaga

SEQ ID NO: 10670 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGAT
gcctcagccttccgaggagc

SEQ ID NO: 10671 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
gctcaccgcaatctccgctc

SEQ ID NO: 10672 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
tgtttgtttgtttgttttga

SEQ ID NO: 10673 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ttatgtcaaatcatgatgag

SEQ ID NO: 10674 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
aagatggtcacagcttgggg

SEQ ID NO: 10675 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ctaaatatgggagtagaaag

SEQ ID NO: 10676 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
taccccattgggctaaatat

SEQ ID NO: 10677 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tagagaaagagtgtatacaa

SEQ ID NO: 10678 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tttaaagtaaggaatagaga

SEQ ID NO: 10679 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gtttccttctttttaaagta

SEQ ID NO: 10680 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tgtagagagattctaatttt

SEQ ID NO: 10681 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
atagtctacttagggttttt

SEQ ID NO: 10682 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
cattgcccttatagtctact

SEQ ID NO: 10683 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcggccttccaaagtgc

SEQ ID NO: 10684 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
ttttgtatttttagtagaga

SEQ ID NO: 10685 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcagcctcctgagtagc

SEQ ID NO: 10686 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
aattcttctgcctcagcctc

SEQ ID NO: 10687 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttcactcttgttgcccaggc

SEQ ID NO: 10688 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
tttttattttttttgtgaga

SEQ ID NO: 10689 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tatagacaagtccacgaacc

SEQ ID NO: 10690 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
catagaatttttgtagtata

SEQ ID NO: 10691 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
atgcaggaataatagaatca

SEQ ID NO: 10692 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aattatccatgcaggaataa

SEQ ID NO: 10693 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tactggtaaattatccatgc

SEQ ID NO: 10694 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tctctccttacataaaaagc

SEQ ID NO: 10695 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
taaaggcagaatgcccagac

SEQ ID NO: 10696 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aaagagaaagctgttaaagg

SEQ ID NO: 10697 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tgtgtttctgaggcacatat

SEQ ID NO: 10698 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
cctaaaatcagcagagatga

SEQ ID NO: 10699 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
cttctcatattcttaaattt

SEQ ID NO: 10700 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
tcatttacaaaatttcatta

SEQ ID NO: 10701 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
agagctcaattcaatgtgtc

SEQ ID NO: 10702 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
agagaatgtgtttacaaaca

SEQ ID NO: 10703 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
agtgggcaagatgattgaca

SEQ ID NO: 10704 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
taaaatgttctttttgagct

SEQ ID NO: 10705 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gatttttttaaaacttagat

SEQ ID NO: 10706 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
tcatttcaccaccctgatgt

SEQ ID NO: 10707 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
acaaagtcaggaaatgtaat

SEQ ID NO: 10708 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
aagactgatgaatccagcca

SEQ ID NO: 10709 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
cttgtccatagcaaagactg

SEQ ID NO: 10710 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
caacccccaagactaatgac

SEQ ID NO: 10711 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
gctctaaagacttggatgta

SEQ ID NO: 10712 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
gggcacttggctctaaagac

SEQ ID NO: 10713 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ccaatctaatcaagaagggt

SEQ ID NO: 10714 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
ttgtttccaatctaatcaag

SEQ ID NO: 10715 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gtaaacatatcacactatac

SEQ ID NO: 10716 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gtgtttcttaagaaacgcca

SEQ ID NO: 10717 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGGGT
tagttttttctccccatttt

SEQ ID NO: 10718 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tccataagtcagataaatcc

SEQ ID NO: 10719 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
gaatagaacagtctttaaag

SEQ ID NO: 10720 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aacaagcatgtaaaacttta

SEQ ID NO: 10721 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tatttctggtcttgtagcaa

SEQ ID NO: 10722 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
aatatttctatacttcagta

SEQ ID NO: 10723 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
acatttttaatcagttcatt

SEQ ID NO: 10724 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gtatcttgatcagtatatag

SEQ ID NO: 10725 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttctaaaataggctctgatt

SEQ ID NO: 10726 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
atctggagacccgttttcag

SEQ ID NO: 10727 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ttatcaattgttggtggcaa

SEQ ID NO: 10728 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
acttcggcctcccaaagtgc

SEQ ID NO: 10729 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
tttttgtatttttgaaggga

SEQ ID NO: 10730 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aagggtctcttgttcattga

SEQ ID NO: 10731 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gacaaagggtctcttgttca

SEQ ID NO: 10732 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
caaatttcctattgcagaca

SEQ ID NO: 10733 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
taaacgtagaataatgtagc

SEQ ID NO: 10734 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
acctttggggaaattaaacg

SEQ ID NO: 10735 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tcagataaagggaacattat

SEQ ID NO: 10736 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
aaagcaagtaatcaggtgat

SEQ ID NO: 10737 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaagagaagctgatgaaggg

SEQ ID NO: 10738 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
gggagaaagagaagctgatg

SEQ ID NO: 10739 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
gaaataaagcactgtagaag

SEQ ID NO: 10740 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aatttcctgtctatgaagtt

SEQ ID NO: 10741 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tagcgtgcttcttcaagtgc

SEQ ID NO: 10742 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atgtaaaatcaatgatagtt

SEQ ID NO: 10743 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
tgaggagaaaaagagcaatt

SEQ ID NO: 10744 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gcacatatcagcctccataa

SEQ ID NO: 10745 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ggggaaacaggttgtaatag

SEQ ID NO: 10746 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
atttgtgtaatcccaaatta

SEQ ID NO: 10747 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tgctgtgaacttaaaaactt

SEQ ID NO: 10748 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ttaaatacttgatcgctttg

SEQ ID NO: 10749 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
gttagggttaatcaaccatc

SEQ ID NO: 10750 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
tttaatggcaaaaattaagt

SEQ ID NO: 10751 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tttctgcaaataaatgtgtc

SEQ ID NO: 10752 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aaaaaaatcagtaattttct

SEQ ID NO: 10753 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
agctatgattgcaccacagc

SEQ ID NO: 10754 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tcatatcactgcactccagc

SEQ ID NO: 10755 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
agaggcagaggttgcagtga

SEQ ID NO: 10756 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tatatataaaagaagacagg

SEQ ID NO: 10757 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ccttggcaaacaagaaaata

SEQ ID NO: 10758 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gttactgcataattccttta

SEQ ID NO: 10759 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
atgccactgcactccagact

SEQ ID NO: 10760 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ggctgaggcaggagaatcac

SEQ ID NO: 10761 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tactcaggaggctgaggcag

SEQ ID NO: 10762 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
gaaaagaggcagaggctgag

SEQ ID NO: 10763 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tgtacagtagctctgaggag

SEQ ID NO: 10764 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
aatataaggtttatttagaa

SEQ ID NO: 10765 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gtattaatataaggtttatt

SEQ ID NO: 10766 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
ccattatgtgtgtaaaaatg

SEQ ID NO: 10767 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gaacttgaatgaatgaatga

SEQ ID NO: 10768 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gaatgaacttgaatgaatga

SEQ ID NO: 10769 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tctggaatgaacttgaatga

SEQ ID NO: 10770 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tatgtctggaatgaacttga

SEQ ID NO: 10771 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaaatatgtctggaatgaac

SEQ ID NO: 10772 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
tagttcctctaaaatatgtc

SEQ ID NO: 10773 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ttactaactgctctgatgct

SEQ ID NO: 10774 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
acttaaaaatgttctgttct

SEQ ID NO: 10775 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
gctatttatggggaaaaaat

SEQ ID NO: 10776 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tattcttcaaaaataaatat

SEQ ID NO: 10777 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
atttttcgttatacatactt

SEQ ID NO: 10778 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tgggaaacattgaagagtga

SEQ ID NO: 10779 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tggatggctgggaaacattg

SEQ ID NO: 10780 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
gttgtccacaggggaggaat

SEQ ID NO: 10781 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
actgtggttgtccacagggg

SEQ ID NO: 10782 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
accacatggatggatacaca

SEQ ID NO: 10783 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atgctgataaaaccacatgg

SEQ ID NO: 10784 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atacatgctgataaaaccac

SEQ ID NO: 10785 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttatttgcatgaaaagaaaa

SEQ ID NO: 10786 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ggtatgaaacaatgtttata

SEQ ID NO: 10787 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
tgtgggaatgactaaataat

SEQ ID NO: 10788 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
acctaaatgttctacagtgt

SEQ ID NO: 10789 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gttacaaaaagagcccacaa

SEQ ID NO: 10790 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
gtggagggtggcaggaggga

SEQ ID NO: 10791 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
ctggggcccattggagggtg

SEQ ID NO: 10792 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
acacacactggggcccattg

SEQ ID NO: 10793 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
cgtactgtgaaactattcaa

SEQ ID NO: 10794 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
cgttacactaggtaacaaaa

SEQ ID NO: 10795 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
aaagatcagcagagttaggg

SEQ ID NO: 10796 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ttcttaaagatcagcagagt

SEQ ID NO: 10797 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
acctgtttcttaaagatcag

SEQ ID NO: 10798 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
tcaactgtcatggcactggt

SEQ ID NO: 10799 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
cttcttctggtcattgtcat

SEQ ID NO: 10800 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ggtggtgaacttcttggaac

SEQ ID NO: 10801 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tggtcattaagagtgagggg

SEQ ID NO: 10802 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
taatgaagaagttggtcatt

SEQ ID NO: 10803 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
agctaacttcttgactagtg

SEQ ID NO: 10804 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
caagctttattcgatggcca

SEQ ID NO: 10805 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ggattgataggcctttatga

SEQ ID NO: 10806 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
acacattgtttggggagagc

SEQ ID NO: 10807 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
aaaattagccgggtgtggtg

SEQ ID NO: 10808 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
actaaaggtacaaaaattag

SEQ ID NO: 10809 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tgggtggatcacatgaggtc

SEQ ID NO: 10810 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
actttgggaagctgagatgg

SEQ ID NO: 10811 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
cagcactttgggaagctgag

SEQ ID NO: 10812 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
aagaattaagaagttttcgg

SEQ ID NO: 10813 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaaatgcaaactaaaatgat

SEQ ID NO: 10814 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
aaaaagcacaaatggcatct

SEQ ID NO: 10815 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gctaattttattattttgtt

SEQ ID NO: 10816 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
agccactggagaaaggattg

SEQ ID NO: 10817 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aacacaggagccactggaga

SEQ ID NO: 10818 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gtcattacaaggtttgaggg

SEQ ID NO: 10819 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
cttttttcttttcacctgag

SEQ ID NO: 10820 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
taacccaagatacattttag

SEQ ID NO: 10821 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tgggacacctgggtagtcat

SEQ ID NO: 10822 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
aatagttatcattgggacac

SEQ ID NO: 10823 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaatagacatagttacatat

SEQ ID NO: 10824 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ataatgttattttatgcaaa

SEQ ID NO: 10825 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
gggaaattgtacacacataa

SEQ ID NO: 10826 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
cccatttggaattagataat

SEQ ID NO: 10827 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
aaaatagaaattttcccatt

SEQ ID NO: 10828 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
agaggtattaaaaaaagagt

SEQ ID NO: 10829 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
taaagaagaggtattaaaaa

SEQ ID NO: 10830 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
ttaacattagaggttctaaa

SEQ ID NO: 10831 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
ttaacataatgttacttatg

SEQ ID NO: 10832 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
taagaaataataattatttt

SEQ ID NO: 10833 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tactataaaatgccataaaa

SEQ ID NO: 10834 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aaatagtccctatcagttgt

SEQ ID NO: 10835 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tcacaatattttaataatca

SEQ ID NO: 10836 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
tataatataaatgattatta

SEQ ID NO: 10837 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttcatttcttataaacttg

SEQ ID NO: 10838 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcggcttcccaaagtgc

SEQ ID NO: 10839 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ccatgttggtcaggctggtc

SEQ ID NO: 10840 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGGT
ttttgtatttttagtagaga

SEQ ID NO: 10841 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcagcctcctgagtagc

SEQ ID NO: 10842 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
agttctcctgcctcagcctc

SEQ ID NO: 10843 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
agctcactacaatccacctc

SEQ ID NO: 10844 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttcgctcttgttgcccaggc

SEQ ID NO: 10845 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
ttttttttttttttttgaga

SEQ ID NO: 10846 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
acactaatcttaagttttcc

SEQ ID NO: 10847 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tgctgtacagataagacttt

SEQ ID NO: 10848 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
agtcttaactaacagagaga

SEQ ID NO: 10849 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
ttctctctaattatttaaat

SEQ ID NO: 10850 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
atgttgatgttttgagggaa

SEQ ID NO: 10851 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgctgcagagctaattata

SEQ ID NO: 10852 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
atttctctctttcatttatg

SEQ ID NO: 10853 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tttcagtctgtatagggaag

SEQ ID NO: 10854 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tggagccatgaatttaacaa

SEQ ID NO: 10855 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gcctctctcactctggagcc

SEQ ID NO: 10856 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
aagctagtaagcagtagaga

SEQ ID NO: 10857 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tttccactaaaataacctta

SEQ ID NO: 10858 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
attttagtctttaaaatatt

SEQ ID NO: 10859 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aggcccacatcctgtagaca

SEQ ID NO: 10860 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
ttatcaaacctgatggattt

SEQ ID NO: 10861 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atccacatttatcaaacctg

SEQ ID NO: 10862 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
cataattctgctcagtccta

SEQ ID NO: 10863 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
cttggattttgccttcttga

SEQ ID NO: 10864 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tgtgcttggattttgccttc

SEQ ID NO: 10865 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
atcagcagctgttactgtgc

SEQ ID NO: 10866 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
ttaacaattcctgccccatc

SEQ ID NO: 10867 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttaactcacttattttgata

SEQ ID NO: 10868 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
caatgtccacaaatgttcca

SEQ ID NO: 10869 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
atgtcttcatcaaaaatctt

SEQ ID NO: 10870 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tagtactttaccatctccag

SEQ ID NO: 10871 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
tcatattcccagattatggt

SEQ ID NO: 10872 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tgcattttaaacaatatcac

SEQ ID NO: 10873 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tttaacaacaacaacagaaa

SEQ ID NO: 10874 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aatagccataccctttatct

SEQ ID NO: 10875 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
cctgtgattgttatctaatt

SEQ ID NO: 10876 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
atataaatttgaggaaggat

SEQ ID NO: 10877 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tctggaatataaatttgagg

SEQ ID NO: 10878 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttaggcaaaacacttccttc

SEQ ID NO: 10879 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
tataaatttgatcaggagtc

SEQ ID NO: 10880 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tctggaatataaatttgatc

SEQ ID NO: 10881 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttaataattttaattccttc

SEQ ID NO: 10882 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
cctatgcacttgctttatct

SEQ ID NO: 10883 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
aaagttaagcacctttgtca

SEQ ID NO: 10884 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gaacaggtcaattcatcagt

SEQ ID NO: 10885 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
ggcaataccttttcccactg

SEQ ID NO: 10886 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
ttttgttaaagtgttttcag

SEQ ID NO: 10887 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gatcaatgatttctactatt

SEQ ID NO: 10888 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
tgagtaaacaaattgaatta

SEQ ID NO: 10889 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttaatacttgagtaaacaaa

SEQ ID NO: 10890 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
acagagaaggtgcttaatac

SEQ ID NO: 10891 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
tagatatgattaaatcaaac

SEQ ID NO: 10892 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
tatccttgcctagctagtta

SEQ ID NO: 10893 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
taggagaattcctgatggga

SEQ ID NO: 10894 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
taaatatactagcaatttag

SEQ ID NO: 10895 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
ttataccagtattaaaactt

SEQ ID NO: 10896 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ccagagatctggtttttagt

SEQ ID NO: 10897 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
atataattcgtagactctaa

SEQ ID NO: 10898 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
caattattttctcccatcat

SEQ ID NO: 10899 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tttattttttgttgaggagt

SEQ ID NO: 10900 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tgcttgtttattttttgttg

SEQ ID NO: 10901 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
tattcctatcagcaatgcac

SEQ ID NO: 10902 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tataccctaaagtagaattg

SEQ ID NO: 10903 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ttaggatgtataccctaaag

SEQ ID NO: 10904 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
cgtcccttctattaattgtt

SEQ ID NO: 10905 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGGT
gttcatctgttgatagacat

SEQ ID NO: 10906 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atccgggtcgtagcatatat

SEQ ID NO: 10907 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
aatgttttcaaggtgttcat

SEQ ID NO: 10908 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
accactattctactttctct

SEQ ID NO: 10909 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
acggatctcaaaacacgcta

SEQ ID NO: 10910 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ACGGAT
ttactgactctttctgcctt

SEQ ID NO: 10911 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
aaggagacaccgcatgttgt

SEQ ID NO: 10912 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
cattttggaaacttaatggt

SEQ ID NO: 10913 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
ataagacaaagattacaatt

SEQ ID NO: 10914 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
ctcttcctgtctgtaatgga

SEQ ID NO: 10915 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
atattctcttcctgtctgta

SEQ ID NO: 10916 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
aactggatctctttctggac

SEQ ID NO: 10917 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
atgagtgtgctcttttttaa

SEQ ID NO: 10918 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
gggtacaactttggaaaggg

SEQ ID NO: 10919 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gcatgggtacaactttggaa

SEQ ID NO: 10920 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
ccaatgctaaaattaccagc

SEQ ID NO: 10921 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
agggtttttcttgattttgt

SEQ ID NO: 10922 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGGT
caagattgaaagcagaagat

SEQ ID NO: 10923 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
gggagctagctaaacaactg

SEQ ID NO: 10924 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aaaaattttatacagggtat

SEQ ID NO: 10925 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGGT
gtggtctgaaaaattttata

SEQ ID NO: 10926 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaaaacaataaaacaggaca

SEQ ID NO: 10927 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ctcagcatttatactcttcc

SEQ ID NO: 10928 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
agggcagtggtaagcggctg

SEQ ID NO: 10929 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gcctccaaaatgtgtaggtc

SEQ ID NO: 10930 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
caactgatttatcttagcct

SEQ ID NO: 10931 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
aatgtggtctgtatataaaa

SEQ ID NO: 10932 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
aaatgatcatcaacagataa

SEQ ID NO: 10933 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tatgatccagcaattgaaat

SEQ ID NO: 10934 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
aagcattgtccactgttggt

SEQ ID NO: 10935 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aaaaagtgaaaggtgttgtt

SEQ ID NO: 10936 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tcaatctattttagtgattt

SEQ ID NO: 10937 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aaccatgggaaatttggccc

SEQ ID NO: 10938 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
tccacttagatactgtactt

SEQ ID NO: 10939 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
aatgcaagaagttgactttt

SEQ ID NO: 10940 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
atttagatattctatattgg

SEQ ID NO: 10941 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
aaaagcaaagtgatcttgtg

SEQ ID NO: 10942 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
tctgaaatggagaagaaaca

SEQ ID NO: 10943 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
aaaaaaattaaaaaaatgtc

SEQ ID NO: 10944 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
ttctcgggaggctgaggcag

SEQ ID NO: 10945 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
caggctgatcacttgaggtc

SEQ ID NO: 10946 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ggaaatatgtataaaatgtc

SEQ ID NO: 10947 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
tagaaaagatttgaaaaaag

SEQ ID NO: 10948 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
tgacttcactttcctggtct

SEQ ID NO: 10949 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ttttgaagttgttttatagg

SEQ ID NO: 10950 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
aagtttgaagacattatgaa

SEQ ID NO: 10951 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
ttcttggacaccaattcctg

SEQ ID NO: 10952 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aaaacaacaaaaaaagaaag

SEQ ID NO: 10953 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaagaaatcttatatattcc

SEQ ID NO: 10954 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
actcacaatggttactaaac

SEQ ID NO: 10955 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gctaactgagcagtttgtta

SEQ ID NO: 10956 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
acctcggccttctaaagtgt

SEQ ID NO: 10957 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAAT
ccatgttggccagactagtc

SEQ ID NO: 10958 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGGT
ttttgcagttttagtagaga

SEQ ID NO: 10959 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcagcctcccaagtagc

SEQ ID NO: 10960 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tttcactctgttgcccaggc

SEQ ID NO: 10961 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
taagtttcaaggtacatttg

SEQ ID NO: 10962 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctaggccccccaaagtgc

SEQ ID NO: 10963 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
ggcaggctggtcttgaactc

SEQ ID NO: 10964 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
ttttgtatttttagtagaga

SEQ ID NO: 10965 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGGAT
gcctcagcctcccgagtagc

SEQ ID NO: 10966 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
aattctcctgcctcagcctc

SEQ ID NO: 10967 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
ttcactcttgttgcccaggc

SEQ ID NO: 10968 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
tcttttttttttttttgaga

SEQ ID NO: 10969 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tatctaggcatttaataact

SEQ ID NO: 10970 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
cttacacatgataagtagat

SEQ ID NO: 10971 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
actatattatatgttatata

SEQ ID NO: 10972 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAGT
aaaagcacagataaataaat

SEQ ID NO: 10973 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
agatcagctgacagactttt

SEQ ID NO: 10974 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ggcctactcagggatcaact

SEQ ID NO: 10975 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
aaaagggaagtggcctactc

SEQ ID NO: 10976 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
aatattataaagttgaagtg

SEQ ID NO: 10977 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
ttggtaagtgatgcctttat

SEQ ID NO: 10978 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ttgaggacattttgaatagg

SEQ ID NO: 10979 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
tttattgaggacattttgaa

SEQ ID NO: 10980 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
gataatttattgaggacatt

SEQ ID NO: 10981 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
acagtgtatcttttagggct

SEQ ID NO: 10982 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
gctggaggattgcttgatcc

SEQ ID NO: 10983 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
actttgggaggccgaggctg

SEQ ID NO: 10984 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
agatattcaaatccatgcag

SEQ ID NO: 10985 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
cttcttgagagtctatactt

SEQ ID NO: 10986 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAGT
taaaaatatgtcatcttctt

SEQ ID NO: 10987 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
tttaactgggggtaatttca

SEQ ID NO: 10988 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
ttattattattattttaact

SEQ ID NO: 10989 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
gcctcgacctcccaaagtgc

SEQ ID NO: 10990 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
cggagtttcaccatgttagc

SEQ ID NO: 10991 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
ttttgtatttttagtagaga

SEQ ID NO: 10992 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGAGT
ccattctcctgcctcagcct

SEQ ID NO: 10993 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
ctcactgcaagctccgcgtc

SEQ ID NO: 10994 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAGT
tctcgctctgtcgcccaggc

SEQ ID NO: 10995 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
tattttttatttttttgaga

SEQ ID NO: 10996 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agttagcatcctgccctgca

SEQ ID NO: 10997 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tgttcacttggaaatttaga

SEQ ID NO: 10998 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
aataaagctctaattgcacc

SEQ ID NO: 10999 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tggattttttacaaagcttt

SEQ ID NO: 11000 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
aatttctttaaaatgtctcc

SEQ ID NO: 11001 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
ttgaattgacatatgtagaa

SEQ ID NO: 11002 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
ataatctgccacagacaagt

SEQ ID NO: 11003 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ataaagtggggaaggaagag

SEQ ID NO: 11004 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tttggaggaatgaaaccctt

SEQ ID NO: 11005 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
aaaggtggaatgaagtttgg

SEQ ID NO: 11006 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
cagctcttggcagctaaagg

SEQ ID NO: 11007 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
atgtgggtagaatacttttg

SEQ ID NO: 11008 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
gagcatccagagaatgtggg

SEQ ID NO: 11009 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
tatgagagcatccagagaat

SEQ ID NO: 11010 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aggatttatgagagcatcca

SEQ ID NO: 11011 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
tgtataaaaatattttatat

SEQ ID NO: 11012 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
catcttcctttagaactgtg

SEQ ID NO: 11013 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
tgctctgaagaggacatatt

SEQ ID NO: 11014 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ttatttcactaattgtgagc

SEQ ID NO: 11015 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tgattgtgtcattttcatac

SEQ ID NO: 11016 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAGT
tgaagacccatcactgttat

SEQ ID NO: 11017 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
ccagtcaatagtcactgact

SEQ ID NO: 11018 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGGAT
aaatatattttaagaaaaaa

SEQ ID NO: 11019 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agcatattaaccctggaaac

SEQ ID NO: 11020 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tacaaaaatatggattcttc

SEQ ID NO: 11021 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
aaataataaaatacaaaaat

SEQ ID NO: 11022 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
gtgcctggcatcaagtagta

SEQ ID NO: 11023 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ttcattgttgacttagcttc

SEQ ID NO: 11024 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
ttacagcatgcaggtatttt

SEQ ID NO: 11025 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ggtcatcatcataatttact

SEQ ID NO: 11026 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
tttcctcccatcttcattat

SEQ ID NO: 11027 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
aaaagagtgtgaagtgctag

SEQ ID NO: 11028 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAGT
tattcctattagttatgcaa

SEQ ID NO: 11029 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agtagaatttttcattttac

SEQ ID NO: 11030 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
ctctgtggcaaggaaaaaag

SEQ ID NO: 11031 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
aaattcagaagagcaatcag

SEQ ID NO: 11032 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAGT
ttttactacctgttgctgtg

SEQ ID NO: 11033 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAGT
gatgcttctacagaagaaag

SEQ ID NO: 11034 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
atggtgcagggctaggctca

SEQ ID NO: 11035 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGAT
gtgatgtgtttttacagtga

SEQ ID NO: 11036 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
atatggtatttgatgtaaag

SEQ ID NO: 11037 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
atcaacaacaaaactctaga

SEQ ID NO: 11038 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGAAT
aagtgatagcttgtcagtta

SEQ ID NO: 11039 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
aatttacatgagaaacttag

SEQ ID NO: 11040 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
tcatttacttttaggaaaaa

SEQ ID NO: 11041 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAAT
agaatccttttaacttttta

SEQ ID NO: 11042 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
agtgaaattcagaaaagatg

SEQ ID NO: 11043 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGAAT
cagattatttatttattttt

SEQ ID NO: 11044 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
tttatttctgtttacgctag

SEQ ID NO: 11045 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGGT
gttctgaaactgtggaaagg

SEQ ID NO: 11046 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGGT
tcctgtgcggttttgactct

SEQ ID NO: 11047 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CCGGGT
aagagaggggagaagcttga

SEQ ID NO: 11048 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGAT
attctgcaggtgcactgggt

SEQ ID NO: 11049 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
agccagattctgcaggtgca

SEQ ID NO: 11050 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
tcggctgaggctgggctagc

SEQ ID NO: 11051 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ggggacccgggcgcgctggg

SEQ ID NO: 11052 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
agggagggagggagggagca

SEQ ID NO: 11053 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
ccccgccctgcgccgcccgc

SEQ ID NO: 11054 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
cgccaccaccgcgcccctag

SEQ ID NO: 11055 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
gccccacccaatgggtggcc

SEQ ID NO: 11056 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGGT
acacacacacgccccaccca

SEQ ID NO: 11057 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGGGT
aggaaagggatgatgggggc

SEQ ID NO: 11058 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
gctgagcaggaagggaggaa

SEQ ID NO: 11059 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CGGAGT
ggtccccacctcctctgctc

SEQ ID NO: 11060 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TCGGGT
ctgatggcatattcagataa

SEQ ID NO: 11061 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
acgcacacactccacacaaa

SEQ ID NO: 11062 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGGAT
cagcagggaaaagtagaccc

SEQ ID NO: 11063 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aatagcacatcttacaagtc

SEQ ID NO: 11064 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
tttgtccaggatatggcact

SEQ ID NO: 11065 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
ggaagagaaggcgatttgtc

SEQ ID NO: 11066 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
aaataaaattttaaaaataa

SEQ ID NO: 11067 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAGT
gggggaggctattcttgtgt

SEQ ID NO: 11068 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
acaaatgtttcattctggtg

SEQ ID NO: 11069 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGAAT
tatatatttgcctaacccca

SEQ ID NO: 11070 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
ctctgtaagatactgtaatg

SEQ ID NO: 11071 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
agatgaataagtggaacaca

SEQ ID NO: 11072 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gccaggggttgaaatgggag

SEQ ID NO: 11073 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGGT
taaaatgatcagtacttgcc

SEQ ID NO: 11074 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGAT
attctgtattattgcaacta

SEQ ID NO: 11075 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAGT
aaagcatattgctaagtgaa

SEQ ID NO: 11076 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
actatggtaccaccagtcaa

SEQ ID NO: 11077 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
agatgtccttcagtaggtga

SEQ ID NO: 11078 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGAAT
aacaagatgtccttcagtag

SEQ ID NO: 11079 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
aactctcatgtattgctggt

SEQ ID NO: 11080 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGGAT
gatgatatcaagttctggcc

SEQ ID NO: 11081 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
agataccaccacatatgtat

SEQ ID NO: 11082 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
tgcattatatattccactct

SEQ ID NO: 11083 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TGGAAT
ttgttaatggatgcttaaag

SEQ ID NO: 11084 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
agaatagtaagttcttgtta

SEQ ID NO: 11085 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGAAT
aacaagaacctagatatatt

SEQ ID NO: 11086 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGGAT
tttttggttttatcattttc

SEQ ID NO: 11087 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
ggatccctcagtcagaccaa

SEQ ID NO: 11088 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
ctcacagggaaaatcctgca

SEQ ID NO: 11089 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGAAT
gaaagaaaattgggaaaata

SEQ ID NO: 11090 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
cagctaatgttctgtagact

SEQ ID NO: 11091 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CTGGGT
aatttggaaagatacttttt

SEQ ID NO: 11092 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: ATGGAT
attcttattcctattctggt

SEQ ID NO: 11093 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GTGGAT
attgtggaaaatacagaagt

SEQ ID NO: 11094 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
ttattcttctattttcacaa

SEQ ID NO: 11095 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TTGAAT
tataatttgaagttctactt

SEQ ID NO: 11096 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGAAT
gacactggggaaaattcttc

SEQ ID NO: 11097 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
attatcagcaaaaccattgt

SEQ ID NO: 11098 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GGGAAT
ctaatggaagacttctacaa

SEQ ID NO: 11099 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AGGGAT
tcactttctttctcttctct

SEQ ID NO: 11100 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAAT
tttttgttttcacacaattg

SEQ ID NO: 11101 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: TAGGGT
ctgtagttctttctctggct

SEQ ID NO: 11102 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: AAGAAT
actatccctgtgtgaggtcc

SEQ ID NO: 11103 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: GAGGAT
gtcttttcactttgactggg

SEQ ID NO: 11104 - DNA, 20 bp, synthetic construct
  source 1..20: mol_type = other DNA; note = Description of Artificial Sequence: Synthetic oligonucleotide; note = Target: SCN9A; (-) strand; PAM type: NNGRRT; PAM sequence: CAGAGT
gctaagataagacccttctg

SEQ ID NO: 11105 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
atttttatttgtcataactg

SEQ ID NO: 11106 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tttgtcataactgtggaatt

SEQ ID NO: 11107 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
caggacagccactcacaaca

SEQ ID NO: 11108 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ataaatgtctgattttaatg

SEQ ID NO: 11109 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agaaagcactggcactgtat

SEQ ID NO: 11110 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ctggcactgtataagaatgt

SEQ ID NO: 11111 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
acttgtagacagtaatagta

SEQ ID NO: 11112 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
gagtttgtaaaatctttgct

SEQ ID NO: 11113 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaaatctttgctgaggattt

SEQ ID NO: 11114 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ataataatggagaaatatta

SEQ ID NO: 11115 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tccactctggctactgtact

SEQ ID NO: 11116 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aatagatttggaagtgaggc

SEQ ID NO: 11117 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gatttggaagtgaggcaaga

SEQ ID NO: 11118 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
taaagaggttaaaggtggta

SEQ ID NO: 11119 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
aggttaaaggtggtaatgga

SEQ ID NO: 11120 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
atttacattacattaggtgg

SEQ ID NO: 11121 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ggtagaatgaactggtcttg

SEQ ID NO: 11122 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
ggtcttggtgaataaatgcg

SEQ ID NO: 11123 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aaatgcggagggttaatgaa

SEQ ID NO: 11124 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aagaggattagtttggaaaa

SEQ ID NO: 11125 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ggattagtttggaaaactgg

SEQ ID NO: 11126 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
gttgtcccttagtatctgct

SEQ ID NO: 11127 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gattggcttctggactccct

SEQ ID NO: 11128 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ctacacatcacttcatttgt

SEQ ID NO: 11129 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
gttttgccttttggggcttt

SEQ ID NO: 11130 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ttccccaactatttctgatc

SEQ ID NO: 11131 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tatttctgatccagaattgg

SEQ ID NO: 11132 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gaatccacagatcagaaacc

SEQ ID NO: 11133 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gaaaccatggatatggagga

SEQ ID NO: 11134 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
cctccatttgaagacacagt

SEQ ID NO: 11135 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tctattattatctctgactc

SEQ ID NO: 11136 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
caagcatgtaacatgctaaa

SEQ ID NO: 11137 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aaagtgaattatgttactct

SEQ ID NO: 11138 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ttggcctacattttaaaggc

SEQ ID NO: 11139 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ttgcccattttctttggctt

SEQ ID NO: 11140 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aatttgtaaggtgctttgcc

SEQ ID NO: 11141 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tttgccaagaataaggtgca

SEQ ID NO: 11142 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
cactgaatggtaaacacgat

SEQ ID NO: 11143 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
aatttttgtgaggcaggagc

SEQ ID NO: 11144 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
attttttctgttctgttaga

SEQ ID NO: 11145 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tataaaaatgagcagttctc

SEQ ID NO: 11146 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tttaacatattgtcaatgta

SEQ ID NO: 11147 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
gaagacacaagatatttaaa

SEQ ID NO: 11148 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gaagggccagccataagtaa

SEQ ID NO: 11149 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
tttagaaatagtaatttaat

SEQ ID NO: 11150 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
gagtgtattcttaatattca

SEQ ID NO: 11151 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
acacatcactaaaaataaaa

SEQ ID NO: 11152 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
attatgatggtatattagag

SEQ ID NO: 11153 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aagaattatatttttataga

SEQ ID NO: 11154 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
gccagcaaatattacaactt

SEQ ID NO: 11155 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
attaatgtaggtatggctcg

SEQ ID NO: 11156 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
gtatggctcgcagagtaata

SEQ ID NO: 11157 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tatcctgcagctcattttgc

SEQ ID NO: 11158 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tagcattatctacaatgtga

SEQ ID NO: 11159 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tcacaatcacttatgttgaa

SEQ ID NO: 11160 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gtgattataattctattttg

SEQ ID NO: 11161 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
cctagtatggcaattatttt

SEQ ID NO: 11162 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
tgatgcttatagctaaagta

SEQ ID NO: 11163 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tcctgattttaatatgttgt

SEQ ID NO: 11164 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
taaatatttactacctacca

SEQ ID NO: 11165 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gtcattatttaacattcatg

SEQ ID NO: 11166 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctgtatgatacagaggtagc

SEQ ID NO: 11167 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gttgaggcccatataggtta

SEQ ID NO: 11168 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
gaatgtattcagcaaactca

SEQ ID NO: 11169 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tcatagggtcatggcttaac

SEQ ID NO: 11170 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
cccatctgtaaaatgagaaa

SEQ ID NO: 11171 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
gtaatactccatgtggttgt

SEQ ID NO: 11172 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
actccatgtggttgtaaggg

SEQ ID NO: 11173 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aaattagaacaatgacaata

SEQ ID NO: 11174 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aacaatgacaatacagaatc

SEQ ID NO: 11175 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
caatttgctactaaaaatgt

SEQ ID NO: 11176 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
ccctttgcacaaaccttgat

SEQ ID NO: 11177 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atagatctatgaaatttgta

SEQ ID NO: 11178 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ataaaatcatgctaagtatt

SEQ ID NO: 11179 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cagtaggaacacttgaagcc

SEQ ID NO: 11180 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
tacttgggaggctgaggcag

SEQ ID NO: 11181 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gcaggagggttgcttgagcc

SEQ ID NO: 11182 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
tcatgccattgcactctagc

SEQ ID NO: 11183 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
gtaactgcctttctgtattg

SEQ ID NO: 11184 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
taatatgacagtgccttctg

SEQ ID NO: 11185 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ttcataatgcagttatattt

SEQ ID NO: 11186 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gagtttgaaataacggtaga

SEQ ID NO: 11187 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aggtgatgttaaattcttaa

SEQ ID NO: 11188 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
agtggttcaaatagcctaag

SEQ ID NO: 11189 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aatgaacctaagatggtata

SEQ ID NO: 11190 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
aaagaatctttagccctaga

SEQ ID NO: 11191 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGAT
acaaatgtctcaaagtaata

SEQ ID NO: 11192 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
agctcaatttttgcctgtgc

SEQ ID NO: 11193 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atgtctacagctaatgcaaa

SEQ ID NO: 11194 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gcaaaatatatttcacatca

SEQ ID NO: 11195 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tggcaagagagcaagttggc

SEQ ID NO: 11196 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGAT
atttgaaagcttgccaaaca

SEQ ID NO: 11197 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
acaactaactgcatatcagg

SEQ ID NO: 11198 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
atcaactttgcttacagcga

SEQ ID NO: 11199 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aaagcaggaaaatttgacaa

SEQ ID NO: 11200 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
agttatctttgttttttttg

SEQ ID NO: 11201 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tgaggagtgtaatatgtact

SEQ ID NO: 11202 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tggttattctatgaacaaaa

SEQ ID NO: 11203 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
agtcttatccttgttggcat

SEQ ID NO: 11204 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttgttggcatgtgagtcaag

SEQ ID NO: 11205 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aatgaaaaacatttgtagaa

SEQ ID NO: 11206 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaattggttctgatgcaatg

SEQ ID NO: 11207 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatttaagcacctcaaaata

SEQ ID NO: 11208 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
atttattaaaaaccaaaaaa

SEQ ID NO: 11209 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gctataatcaataattccta

SEQ ID NO: 11210 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gagttctcttacgattctta

SEQ ID NO: 11211 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gcccacctttcttaggaaat

SEQ ID NO: 11212 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttagtgactgcactgccttc

SEQ ID NO: 11213 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ttcgagaatattttgataaa

SEQ ID NO: 11214 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tttggcatagacttcctcaa

SEQ ID NO: 11215 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
catatgaaggtggagaggtg

SEQ ID NO: 11216 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ggcatctgttttttctggac

SEQ ID NO: 11217 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
caaaagccatatctttttta

SEQ ID NO: 11218 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
cggtaacgtctataagcacg

SEQ ID NO: 11219 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
tccgttttagtgtggttgtg

SEQ ID NO: 11220 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
gggttcataggacactttgg

SEQ ID NO: 11221 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttcttccatctgtgaacgaa

SEQ ID NO: 11222 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gcaaataagatgtcaagaca

SEQ ID NO: 11223 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tggcaatgagctggactttg

SEQ ID NO: 11224 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
gggttttgctatgagaagag

SEQ ID NO: 11225 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
ccagggcagctgcaaaatca

SEQ ID NO: 11226 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
agtttagagaactctataaa

SEQ ID NO: 11227 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGAT
ctctataaactgggtcgcat

SEQ ID NO: 11228 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
acatgttcaccacaaccagg

SEQ ID NO: 11229 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tgatgatataactaacaaag

SEQ ID NO: 11230 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aaagtagaatattccaacag

SEQ ID NO: 11231 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
gtctccttcaactgaacttc

SEQ ID NO: 11232 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
acttccaggatgaacttttt

SEQ ID NO: 11233 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGGGT
gaactttttttgggtcacag

SEQ ID NO: 11234 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cagtcgggtggcttactgtt

SEQ ID NO: 11235 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGAT
atcaaagcaaagagcagcgt

SEQ ID NO: 11236 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
tttgctcctttgactagacg

SEQ ID NO: 11237 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGAT
attcggccaatcctggcaag

SEQ ID NO: 11238 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
gcaagacggatcactcggaa

SEQ ID NO: 11239 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tatctgtcaactcatttctt

SEQ ID NO: 11240 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGAGT
ttttttttttttttttgaga

SEQ ID NO: 11241 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tctcgctctgtcgcccaggc

SEQ ID NO: 11242 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGGT
ctcactgcaagctccgcctc

SEQ ID NO: 11243 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAGT
cattctcctgcctcagcctc

SEQ ID NO: 11244 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGGT
ttttgtatttttagtagaga

SEQ ID NO: 11245 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
cggggtttcaccttgttagc

SEQ ID NO: 11246 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gcctcggcctcccaaagtgc

SEQ ID NO: 11247 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gccaagacagttattttata

SEQ ID NO: 11248 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ctgaatgcaattacttaaaa

SEQ ID NO: 11249 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ataatagtgttttacatttt

SEQ ID NO: 11250 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
taactattatcaatattttt

SEQ ID NO: 11251 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tatttatttatttttcaaga

SEQ ID NO: 11252 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tcttgctctgtcgccaaagc

SEQ ID NO: 11253 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGAT
ctactgcaatctctgcatcc

SEQ ID NO: 11254 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gattctccagcctcagcctc

SEQ ID NO: 11255 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
acctcggcctcccaatgtgc

SEQ ID NO: 11256 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tttccatttttgttactgaa

SEQ ID NO: 11257 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
agctatgttctcctaattgc

SEQ ID NO: 11258 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
taataatatgttaatagaac

SEQ ID NO: 11259 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tgcatatactatatatagta

SEQ ID NO: 11260 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
cgtatactatatatatagta

SEQ ID NO: 11261 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
cgtatactatatatatagta

SEQ ID NO: 11262 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
cgtatactatatatatagta

SEQ ID NO: 11263 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
cgtatactatatatatagta

SEQ ID NO: 11264 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
cgtatactatatatatagta

SEQ ID NO: 11265 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
cgtatactatatatatagta

SEQ ID NO: 11266 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
cgtatactatatatatagta

SEQ ID NO: 11267 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
actttacacattcaacagta

SEQ ID NO: 11268 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gtatttgcccatgtgtctat

SEQ ID NO: 11269 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttatgatgattttttcccca

SEQ ID NO: 11270 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttttgcatagaaaggactat

SEQ ID NO: 11271 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tatttccacatatttcctac

SEQ ID NO: 11272 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ctatatgtcttaatattttg

SEQ ID NO: 11273 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tcaccctaattttcttccag

SEQ ID NO: 11274 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aattttcttccagatgaatt

SEQ ID NO: 11275 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aagactcattgatattttcc

SEQ ID NO: 11276 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
actttatttttattgcaatt

SEQ ID NO: 11277 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttgtaccttttgaactctaa

SEQ ID NO: 11278 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
atgaagaaggtcattatatt

SEQ ID NO: 11279 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tggccaacaacactaaaaac

SEQ ID NO: 11280 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tttttttttcctgacttaat

SEQ ID NO: 11281 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tgacttaataggaatgcttt

SEQ ID NO: 11282 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atagaaaaacaaccatggca

SEQ ID NO: 11283 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
atgaacaccatggctggttg

SEQ ID NO: 11284 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aacttcactttaaattctgg

SEQ ID NO: 11285 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
cagatatttgttttgctttt

SEQ ID NO: 11286 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttcattgtactgacttactc

SEQ ID NO: 11287 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tcaagagtaaatttgtgttc

SEQ ID NO: 11288 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
agcacacattctccagtgaa

SEQ ID NO: 11289 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
actaggtcaaatatacatcc

SEQ ID NO: 11290 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
attttgttctgcaaagaaat

SEQ ID NO: 11291 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGAAT
gcaaagaaataagaataata

SEQ ID NO: 11292 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aataagaataatatcgaatg

SEQ ID NO: 11293 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
attaaagatgtgcattaaaa

SEQ ID NO: 11294 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tatttttttacccctggtcg

SEQ ID NO: 11295 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aaaataaatgtagttaaaac

SEQ ID NO: 11296 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aattacatatgtgtagaaac

SEQ ID NO: 11297 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
atatttgtattacatataat

SEQ ID NO: 11298 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttattgctaagaaaatttgt

SEQ ID NO: 11299 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atttgtaagaattaaaagta

SEQ ID NO: 11300 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaatatttagaacttttata

SEQ ID NO: 11301 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaagaatagggagccaaatc

SEQ ID NO: 11302 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ccattcacaattactacaaa

SEQ ID NO: 11303 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
acaaagagaataaaatacct

SEQ ID NO: 11304 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
acctaggaatccaacttaca

SEQ ID NO: 11305 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aagaggacacaaacaaatgg

SEQ ID NO: 11306 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tggaagaatattccatgctc

SEQ ID NO: 11307 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ccatatgtagaaagttgaaa

SEQ ID NO: 11308 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tgtacaaaaattaactcaag

SEQ ID NO: 11309 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
caaaagccaaaacagacaaa

SEQ ID NO: 11310 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aaagcaaaagaaactatcat

SEQ ID NO: 11311 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cagagtgaacaggcaaccta

SEQ ID NO: 11312 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ctgacaaaagggctaatatc

SEQ ID NO: 11313 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
actccatcaaaaagtgggca

SEQ ID NO: 11314 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agataccacctcatgccaat

SEQ ID NO: 11315 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aggaaacaacagatgttgga

SEQ ID NO: 11316 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aacgcttttacactgttggt

SEQ ID NO: 11317 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agacagtgtgatgattcctc

SEQ ID NO: 11318 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ttgacccagcaatctcatta

SEQ ID NO: 11319 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
cattactgggtatatactca

SEQ ID NO: 11320 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aaatgtccatcaataataga

SEQ ID NO: 11321 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aatgtggcatatatacacca

SEQ ID NO: 11322 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aatactatgcagccataaaa

SEQ ID NO: 11323 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ctatgcagccataaaaaagg

SEQ ID NO: 11324 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
gcatgttctcactcataagt

SEQ ID NO: 11325 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
tcacacaccaggggcagtta

SEQ ID NO: 11326 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
agggggttgggagctttggg

SEQ ID NO: 11327 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
agaaatacctaatgtaaatg

SEQ ID NO: 11328 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttaaagtataataataaaaa

SEQ ID NO: 11329 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
attattcctttacataaaaa

SEQ ID NO: 11330 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tacctttttaattctaaata

SEQ ID NO: 11331 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
atttcaacataaacacttta

SEQ ID NO: 11332 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttagtataatccatataatt

SEQ ID NO: 11333 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ataattaagaatttattttc

SEQ ID NO: 11334 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tgagatcattacttaacttg

SEQ ID NO: 11335 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ttacttaacttgtagggtgc

SEQ ID NO: 11336 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tatggtttccctttattctc

SEQ ID NO: 11337 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atttttttaattgtttgcta

SEQ ID NO: 11338 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atgggaagcttcccattata

SEQ ID NO: 11339 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ccagacttccctttctgcct

SEQ ID NO: 11340 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gttgttgttgttgtttttga

SEQ ID NO: 11341 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tcttgctctgaggcacaggc

SEQ ID NO: 11342 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctcactgcaacctccacctc

SEQ ID NO: 11343 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gtctcagcctcccaagtagc

SEQ ID NO: 11344 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
ttttgtatttttagtagaga

SEQ ID NO: 11345 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gccttggcctcccaaagtgc

SEQ ID NO: 11346 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gccaccatatccggccacct

SEQ ID NO: 11347 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tcctggttgtcaatatgatg

SEQ ID NO: 11348 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gttgtcaatatgatgaagaa

SEQ ID NO: 11349 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gataaaactaataggagatt

SEQ ID NO: 11350 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
aattcaatagagaaacttgc

SEQ ID NO: 11351 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ccctttaaaacctaggtgga

SEQ ID NO: 11352 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tcaagtcctttcttttgtcc

SEQ ID NO: 11353 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
taaaaccacctcatcattat

SEQ ID NO: 11354 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ataaattgaggtaatgcatg

SEQ ID NO: 11355 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
attaaacttcctgataagat

SEQ ID NO: 11356 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
gaggtgaaaaaagtacttat

SEQ ID NO: 11357 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aaaaagtacttatgaggatg

SEQ ID NO: 11358 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
agttggaaaaactagtaaaa

SEQ ID NO: 11359 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
gttggttattagaaagaggc

SEQ ID NO: 11360 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
cattgcattgtggaaaagat

SEQ ID NO: 11361 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
accactttcaagggagggag

SEQ ID NO: 11362 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tgccattcagtgtgctgcac

SEQ ID NO: 11363 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGGAT
gtgtcctttgtgacattgtg

SEQ ID NO: 11364 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgcaaagcacaaggaacaca

SEQ ID NO: 11365 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
gaattagggaaacaacaaaa

SEQ ID NO: 11366 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gatttataaattgcctaaaa

SEQ ID NO: 11367 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
agatgatacatgaacacaat

SEQ ID NO: 11368 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tcaaatatcagtaaaaactc

SEQ ID NO: 11369 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cagtaaaaactctggaattg

SEQ ID NO: 11370 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ttgaactaaaaaactcccta

SEQ ID NO: 11371 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agacttgatcaaactggaga

SEQ ID NO: 11372 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
aaaaacaaccccatcaaaaa

SEQ ID NO: 11373 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
accccatcaaaaactgggta

SEQ ID NO: 11374 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agataccatctcataccagt

SEQ ID NO: 11375 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aggaaacaacaggtgctgga

SEQ ID NO: 11376 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
agtccgtgtggcgattcctc

SEQ ID NO: 11377 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ttgacccagccatcccatga

SEQ ID NO: 11378 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
catgactgggtatataccca

SEQ ID NO: 11379 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aaatgtccaacaatgataga

SEQ ID NO: 11380 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aatatggcacatatacacca

SEQ ID NO: 11381 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aatactatgcagccataaaa

SEQ ID NO: 11382 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
gcactttctcactcataggt

SEQ ID NO: 11383 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tcacacaccagggcctgttg

SEQ ID NO: 11384 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
ttgtggggtggggggaggag

SEQ ID NO: 11385 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
gatatacctaatgttaaatg

SEQ ID NO: 11386 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
taatgttaaatgatgagtta

SEQ ID NO: 11387 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aagaagaaataaaaaaaaaa

SEQ ID NO: 11388 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
aaatcacagagaagacagaa

SEQ ID NO: 11389 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atctaaattcaggaaactca

SEQ ID NO: 11390 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
agcactttgaggggctgagc

SEQ ID NO: 11391 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
ctttgaggggctgagcggga

SEQ ID NO: 11392 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
ggagtggatcacctgaggtc

SEQ ID NO: 11393 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ccaaaaattacaaaaatcag

SEQ ID NO: 11394 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
aaaatcagctgggtgtggtg

SEQ ID NO: 11395 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
actcgggaggctgaggcaga

SEQ ID NO: 11396 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgaaagcagcaagaaaaaaa

SEQ ID NO: 11397 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaagaaaaaaactgctgacc

SEQ ID NO: 11398 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
actgtcctttaaaattaagg

SEQ ID NO: 11399 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
ctcatacaagcaaatgctga

SEQ ID NO: 11400 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
atcttataggaaatgctaaa

SEQ ID NO: 11401 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ggtaaatacatggacaaata

SEQ ID NO: 11402 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agttaaatgtcaaaataatt

SEQ ID NO: 11403 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gagagaaaaagacagaaaaa

SEQ ID NO: 11404 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
aatgattatttcaaatacaa

SEQ ID NO: 11405 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
cagtcgtccttcagtatcta

SEQ ID NO: 11406 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
gtcatggtttcagaacccca

SEQ ID NO: 11407 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ccccaagggataccaaaatt

SEQ ID NO: 11408 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
cagtcagtcttgcaggacct

SEQ ID NO: 11409 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
aaatttgaccctctgtatct

SEQ ID NO: 11410 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atctgtggatttcacattcc

SEQ ID NO: 11411 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gtgttttcaatcagcattgg

SEQ ID NO: 11412 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
taggtcataaaataagataa

SEQ ID NO: 11413 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tataacaattataaatatat

SEQ ID NO: 11414 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
gcaatcattgacagatctga

SEQ ID NO: 11415 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
atgcagcaacaccataacag

SEQ ID NO: 11416 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
atgaacagaacagccagata

SEQ ID NO: 11417 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
atggaatctataaacaaact

SEQ ID NO: 11418 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tgaacaacgctatagaccaa

SEQ ID NO: 11419 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ccaaatggatcacaaacaca

SEQ ID NO: 11420 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
accatcttttcaagtgcgca

SEQ ID NO: 11421 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aagtgcgcacagaatattct

SEQ ID NO: 11422 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aacactctcttgaaaaagca

SEQ ID NO: 11423 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
agagctaagtaagtgaaata

SEQ ID NO: 11424 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tagaaaaagtcaacaaaact

SEQ ID NO: 11425 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
taaaaccagaaatgaaagag

SEQ ID NO: 11426 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
gaatttacaactgattttat

SEQ ID NO: 11427 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
actgattttatgggaataag

SEQ ID NO: 11428 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
aacaattatacaccaacaaa

SEQ ID NO: 11429 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aacaaattggataacttaga

SEQ ID NO: 11430 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aaatatacaacctaccaaga

SEQ ID NO: 11431 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aagactgaatcatgaggaaa

SEQ ID NO: 11432 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
atcatgaggaaatagaataa

SEQ ID NO: 11433 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cgaaagtcattttatggggc

SEQ ID NO: 11434 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aagtgacttcagcaacattg

SEQ ID NO: 11435 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
aagtaaacatctacatacac

SEQ ID NO: 11436 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cagttctctccagagaaacc

SEQ ID NO: 11437 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
cagaaaatacccatatcaaa

SEQ ID NO: 11438 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
caaatttgcagctacttccc

SEQ ID NO: 11439 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tttctagaaaatgctttttc

SEQ ID NO: 11440 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
cttttagatcaccatgcttg

SEQ ID NO: 11441 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gaatggcagagataagccat

SEQ ID NO: 11442 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
ctcaagtacaaaaaacgatg

SEQ ID NO: 11443 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
ctctcagaagctttaattcc

SEQ ID NO: 11444 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ggaaatctacatagcaaatg

SEQ ID NO: 11445 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ccttcttcagcctaaacaag

SEQ ID NO: 11446 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ttttttttttttttttgaga

SEQ ID NO: 11447 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tctcgctctgtcgcccaggc

SEQ ID NO: 11448 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGGT
ctcactgcaagctccgcctc

SEQ ID NO: 11449 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAGT
cattctcctgcctcagcctc

SEQ ID NO: 11450 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGGT
ttttgtatttttagtagaga

SEQ ID NO: 11451 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
cggggtttcaccgtgttagc

SEQ ID NO: 11452 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gcctcggcctcccaaagtgc

SEQ ID NO: 11453 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aaatcacatgaaacactctc

SEQ ID NO: 11454 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGAGT
ttaagaagattaaaatcata

SEQ ID NO: 11455 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
acatgaaactagaagtcaat

SEQ ID NO: 11456 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aacatgctcctgaacaggca

SEQ ID NO: 11457 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
cggaaaaacagaaaatattt

SEQ ID NO: 11458 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
acacaagataacaaatagta

SEQ ID NO: 11459 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
agagattagaaaaagaagaa

SEQ ID NO: 11460 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
actgataacacataaataca

SEQ ID NO: 11461 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aacaaccatacaccatcaaa

SEQ ID NO: 11462 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
atcaaattgaataacctaga

SEQ ID NO: 11463 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tacatctgaacaaaccaata

SEQ ID NO: 11464 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
aaaaaaggaaaaggtcactg

SEQ ID NO: 11465 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
attctatttaaagaagtaat

SEQ ID NO: 11466 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tatactgatatgaaaaccct

SEQ ID NO: 11467 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
cacaacaatatattagcaaa

SEQ ID NO: 11468 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
catcattcaccatgattact

SEQ ID NO: 11469 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
gattacttgggatttatctg

SEQ ID NO: 11470 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ctcaacaaagcagatatgga

SEQ ID NO: 11471 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tctaagatcaggaacaagac

SEQ ID NO: 11472 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atttcatgttcatgtgttgg

SEQ ID NO: 11473 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atagtaaaaaatcctaacat

SEQ ID NO: 11474 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
agatatattggctaatggaa

SEQ ID NO: 11475 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgattttcagcaaaggtgca

SEQ ID NO: 11476 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aataaatggtgttgggaaaa

SEQ ID NO: 11477 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
actgaatattccttatgcaa

SEQ ID NO: 11478 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tgtatgacatttatctgggc

SEQ ID NO: 11479 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
aaaagacaataagagacaag

SEQ ID NO: 11480 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tacagcaaacgaagcaataa

SEQ ID NO: 11481 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
acagagtggagagagagatc

SEQ ID NO: 11482 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gaaaatcaataaaccaattg

SEQ ID NO: 11483 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
catttctcaaaagaagagat

SEQ ID NO: 11484 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaatattacctcacacctcc

SEQ ID NO: 11485 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gaatggctgttatcaaaaag

SEQ ID NO: 11486 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
gaatgataacaagtgttgat

SEQ ID NO: 11487 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tatatatttaattcctttag

SEQ ID NO: 11488 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
caacctgtacccatcaacag

SEQ ID NO: 11489 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ctgtacccatcaacaggtga

SEQ ID NO: 11490 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
attttgtcattcatcccaac

SEQ ID NO: 11491 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
gatctcacttacatgtaaaa

SEQ ID NO: 11492 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
atggggtggggggagggggg

SEQ ID NO: 11493 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAGT
agatatacctaatgtaaatg

SEQ ID NO: 11494 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ctaatgtaaatgacgagtta

SEQ ID NO: 11495 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
gaaagtataaatcttgatca

SEQ ID NO: 11496 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
aaggatgtacatttttcatt

SEQ ID NO: 11497 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
acatttttcatttagagtag

SEQ ID NO: 11498 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gtagaggaataaatcttaag

SEQ ID NO: 11499 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
caaaaacaaaaattaacaaa

SEQ ID NO: 11500 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
acagcaaaagaaactatcaa

SEQ ID NO: 11501 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cagagtaagcagacagtcta

SEQ ID NO: 11502 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tctgacaaaggtctaatatc

SEQ ID NO: 11503 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
agaatctataaggaacttaa

SEQ ID NO: 11504 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
accccattaaaaagtgggca

SEQ ID NO: 11505 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
agataccatctcacaccagt

SEQ ID NO: 11506 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
aaaaaataacagatgctggc

SEQ ID NO: 11507 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ggcgagggtgtggagaaaaa

SEQ ID NO: 11508 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
aatgcctacacactgttgat

SEQ ID NO: 11509 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
tcaacccagcaatcccatta

SEQ ID NO: 11510 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tattcacaatggcaaagaca

SEQ ID NO: 11511 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aaatgaccatcagtgataga

SEQ ID NO: 11512 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atcatatcctttgcagggac

SEQ ID NO: 11513 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
tgagaacacatggacacata

SEQ ID NO: 11514 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
acacacactggggcctatgg

SEQ ID NO: 11515 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ctggggcctatgggagggtg

SEQ ID NO: 11516 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
gtgaagggtgggaggaagga

SEQ ID NO: 11517 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gaaaaataaccaatgcatac

SEQ ID NO: 11518 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
catactgggattaatacctc

SEQ ID NO: 11519 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gtatatttcaaaattgctaa

SEQ ID NO: 11520 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
ttaccacaaaaaaatgataa

SEQ ID NO: 11521 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttcatcaaaatattagcaaa

SEQ ID NO: 11522 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
atcatgtactacgaccaagt

SEQ ID NO: 11523 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
gaccaagtgggagttgtccc

SEQ ID NO: 11524 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
gggagttgtccctaggatgc

SEQ ID NO: 11525 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
gatacaccacatgatctgag

SEQ ID NO: 11526 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
caatttaattgcaattgtga

SEQ ID NO: 11527 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttaagaggtgtttaagttat

SEQ ID NO: 11528 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
atgcattaatgctgttatct

SEQ ID NO: 11529 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ttaatgctgttatctcagga

SEQ ID NO: 11530 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
attctgttatagtagcacaa

SEQ ID NO: 11531 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aaaaactttcctgtaagatc

SEQ ID NO: 11532 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
agatgacattattttatatg

SEQ ID NO: 11533 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aacaaatttactagatgttg

SEQ ID NO: 11534 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
atcaaaagaaataaaatact

SEQ ID NO: 11535 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
aatggaaagacccagtattc

SEQ ID NO: 11536 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
catactaccctaagtgatct

SEQ ID NO: 11537 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
atatggaaccacaaaagact

SEQ ID NO: 11538 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aagaaaaaagaacaaaatgg

SEQ ID NO: 11539 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tctcaccctgttgcccaggc

SEQ ID NO: 11540 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
ttcaaatatcttcgtaaaga

SEQ ID NO: 11541 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAGT
gatcctccagccttagcctc

SEQ ID NO: 11542 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gccttagcctcccgagttgc

SEQ ID NO: 11543 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aaatatataggccaatgaaa

SEQ ID NO: 11544 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
atagttaactcatattcaac

SEQ ID NO: 11545 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tcatattcaacaggggtgcc

SEQ ID NO: 11546 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aacaaataatgttgggaaaa

SEQ ID NO: 11547 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tcacatataaaaaaataaaa

SEQ ID NO: 11548 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
gaaaaaaaggaagcattcaa

SEQ ID NO: 11549 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gagggtgaaaaagcaaccta

SEQ ID NO: 11550 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
cagcactttgggaggccaag

SEQ ID NO: 11551 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
actttgggaggccaaggtgg

SEQ ID NO: 11552 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tacttgggaagctgaggcag

SEQ ID NO: 11553 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
caggagaatcacttgaacca

SEQ ID NO: 11554 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
actgcactccagcctggtga

SEQ ID NO: 11555 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGAT
actttgggaggccgagacgg

SEQ ID NO: 11556 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
atcgagaccatcctggctaa

SEQ ID NO: 11557 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tacacgggaggctgaggcag

SEQ ID NO: 11558 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
cccgggaggcggagcttgca

SEQ ID NO: 11559 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
agatatcatttcatacctgc

SEQ ID NO: 11560 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aaaagataataggtgttggc

SEQ ID NO: 11561 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ttagaacctttgtacattgt

SEQ ID NO: 11562 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
atattttaaaaatttgaact

SEQ ID NO: 11563 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aaaatttgaactcaggatct

SEQ ID NO: 11564 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aacaacctaaatgtctattg

SEQ ID NO: 11565 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
aaatgtctattgatgaatga

SEQ ID NO: 11566 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atcctgccatatgcagcaac

SEQ ID NO: 11567 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
atgcagcaacttgaatgaac

SEQ ID NO: 11568 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tgaacctggataaatttatg

SEQ ID NO: 11569 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaactcatggaaacagagag

SEQ ID NO: 11570 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tggtgattgccagggcatga

SEQ ID NO: 11571 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gccagggcatgaaaggatgg

SEQ ID NO: 11572 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
catgaaaggatgggagaatg

SEQ ID NO: 11573 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
atggagaattgctattcaat

SEQ ID NO: 11574 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
taaagtttcaattatgcaag

SEQ ID NO: 11575 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aaattaggaaaggcaaagaa

SEQ ID NO: 11576 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tttcatttgttttttttctt

SEQ ID NO: 11577 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
gttttttttctttggaataa

SEQ ID NO: 11578 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttggtcatgttttttcaggg

SEQ ID NO: 11579 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
attgcaagatgaaatactgg

SEQ ID NO: 11580 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
gaaatactggaagaatgata

SEQ ID NO: 11581 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ctggaagaatgataggggat

SEQ ID NO: 11582 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tcctgcagtagaaatgttgt

SEQ ID NO: 11583 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
agcaggaagattaaagtcaa

SEQ ID NO: 11584 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
atcctatgcagggaagactg

SEQ ID NO: 11585 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
acatctgtatttgtaaatgt

SEQ ID NO: 11586 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tgtataggtggtaccacaac

SEQ ID NO: 11587 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
agttagttgacaagaaactc

SEQ ID NO: 11588 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
ggtccaggtggcaggtcaag

SEQ ID NO: 11589 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
atttttctgagaggttaaat

SEQ ID NO: 11590 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tatgttagaagtattttaca

SEQ ID NO: 11591 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
acacaggatctgacatatca

SEQ ID NO: 11592 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttcttccctactcaacatat

SEQ ID NO: 11593 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
cgaaagcattgctatccccc

SEQ ID NO: 11594 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
tcatttctgtttcactccat

SEQ ID NO: 11595 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
ttatcatgattatagtattt

SEQ ID NO: 11596 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tttggggatagagcatagta

SEQ ID NO: 11597 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gagcatagtagagagtttaa

SEQ ID NO: 11598 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGAAT
ttaatagagtacaagataca

SEQ ID NO: 11599 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
cacatactcgatatatgacc

SEQ ID NO: 11600 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
atacttttgtgattgatgtt

SEQ ID NO: 11601 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tttgtgattgatgttatggg

SEQ ID NO: 11602 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
agtcctaacccttagcactt

SEQ ID NO: 11603 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
taattaagatgaagtcatac

SEQ ID NO: 11604 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
aagatgaagtcatactggag

SEQ ID NO: 11605 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gtcactataatgggagagat

SEQ ID NO: 11606 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aacatggacctgctgacact

SEQ ID NO: 11607 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tctaacctccaaaagtgtga

SEQ ID NO: 11608 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aactacttataaaatgtgtt

SEQ ID NO: 11609 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ataggaaacattggaaaaaa

SEQ ID NO: 11610 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
tgatatattgctcaaaacct

SEQ ID NO: 11611 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aaattgttttctgtgcaaaa

SEQ ID NO: 11612 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aagttctaataaaattaatc

SEQ ID NO: 11613 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
caatgaacaagttcaaagtg

SEQ ID NO: 11614 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
agtgctatcctaggtaaaca

SEQ ID NO: 11615 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAAT
ccatgtattttcttttgatt

SEQ ID NO: 11616 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
ttttgtaaaaatattaccta

SEQ ID NO: 11617 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
gccctgcttctattttcttg

SEQ ID NO: 11618 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gttgggtcctcacaacacta

SEQ ID NO: 11619 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
acaacactatggagtaggca

SEQ ID NO: 11620 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
cccgaagtcagttgtagagc

SEQ ID NO: 11621 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
cttggatgatatggtacagc

SEQ ID NO: 11622 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tgatatggtacagctagaat

SEQ ID NO: 11623 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
aaccactaggctactatcag

SEQ ID NO: 11624 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ggatgttcttcattgtctat

SEQ ID NO: 11625 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ataatcaatacttacattaa

SEQ ID NO: 11626 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atcccttaaaagttgccttt

SEQ ID NO: 11627 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gcctttaagaataacattaa

SEQ ID NO: 11628 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aagaataacattaatagaat

SEQ ID NO: 11629 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tattctaaaatagccataaa

SEQ ID NO: 11630 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ctaaattgttacagttgcct

SEQ ID NO: 11631 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
taaaggtgaaggaaaatttt

SEQ ID NO: 11632 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
catcttttctccatttttta

SEQ ID NO: 11633 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gttcatttttgaagcaatat

SEQ ID NO: 11634 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
atatttgaatggtgcaagat

SEQ ID NO: 11635 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tgggagtccacatgacacca

SEQ ID NO: 11636 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tttttttttttttttgagac

SEQ ID NO: 11637 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tctcgctctgtagcccaggc

SEQ ID NO: 11638 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
gcctcagcctcccaagcagc

SEQ ID NO: 11639 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
ttttgtatttttagtagaga

SEQ ID NO: 11640 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tataattaatatactattta

SEQ ID NO: 11641 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
acaaatttactcccatgatg

SEQ ID NO: 11642 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ccatgatgctgaatatcagc

SEQ ID NO: 11643 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
agtagcacattcatgatgga

SEQ ID NO: 11644 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tgatggaaggaattgctcct

SEQ ID NO: 11645 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
aaaagaaagaaaagcatgat

SEQ ID NO: 11646 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
attggtgtatatcaggtagg

SEQ ID NO: 11647 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ttttgagacattctccacaa

SEQ ID NO: 11648 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
acattctccacaaaaggatt

SEQ ID NO: 11649 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
acctgttagggaaggagcac

SEQ ID NO: 11650 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ctttaaaatagagaaatact

SEQ ID NO: 11651 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
tataaatatttttaggcttt

SEQ ID NO: 11652 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
tcaactctgccatggtagtc

SEQ ID NO: 11653 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
acatttttacaaaaacaggc

SEQ ID NO: 11654 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ggtccagagcaatgattatt

SEQ ID NO: 11655 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgacctcaaaaaagattagg

SEQ ID NO: 11656 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
caaaaaagattaggaggaat

SEQ ID NO: 11657 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gattaggaggaataggaata

SEQ ID NO: 11658 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
taccatgtggtatcactgcc

SEQ ID NO: 11659 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGAT
tgatgtcttcccagacttcc

SEQ ID NO: 11660 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGGT
cctactcactctttggggac

SEQ ID NO: 11661 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
aaaatgtttttctaaaaaat

SEQ ID NO: 11662 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ctaaaaaatgtgagtaatga

SEQ ID NO: 11663 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
atgtgagtaatgatggaatc

SEQ ID NO: 11664 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
cttcaaaatagccctgcggc

SEQ ID NO: 11665 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gataaagaacaaagagcaaa

SEQ ID NO: 11666 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aaaaaattaagttaatgtca

SEQ ID NO: 11667 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tgtaattttcaacttgtaga

SEQ ID NO: 11668 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aacttgtagatagaatattt

SEQ ID NO: 11669 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tacttggaaaccgttataca

SEQ ID NO: 11670 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
gcagtcataattaggtttgt

SEQ ID NO: 11671 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
caagtttcttatccccatcc

SEQ ID NO: 11672 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
agtttctgactcagtaggtc

SEQ ID NO: 11673 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gtaggtctggggtgagatcc

SEQ ID NO: 11674 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ttttttttttttttttgata

SEQ ID NO: 11675 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tcttgctctgttccccaggc

SEQ ID NO: 11676 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGGT
ctcactgcaacctctgcctc

SEQ ID NO: 11677 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGGT
acaggtgagcaccactatgc

SEQ ID NO: 11678 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
ttttgcatttttagtagaga

SEQ ID NO: 11679 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
taagtaaaatacaatataat

SEQ ID NO: 11680 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tttaggtgtctgaacagaga

SEQ ID NO: 11681 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGGT
ggtgtttgtctgctatacaa

SEQ ID NO: 11682 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tgtctgctatacaaacgggt

SEQ ID NO: 11683 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
atctggagaagaaattttag

SEQ ID NO: 11684 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ttagaggagtaccaacacat

SEQ ID NO: 11685 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tatggactaattacagaaaa

SEQ ID NO: 11686 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
aacttgtttgtctctgctaa

SEQ ID NO: 11687 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
atatgaaaaaagtcactcat

SEQ ID NO: 11688 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
ttgacaatattagataaagg

SEQ ID NO: 11689 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tatatatatatagagagaga

SEQ ID NO: 11690 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
taatatactagtatatacta

SEQ ID NO: 11691 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ttaaagctctcagtgtccga

SEQ ID NO: 11692 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
ggatttaatggggccaagat

SEQ ID NO: 11693 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gggccaagatctgagtagcc

SEQ ID NO: 11694 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGAGT
gaacaataagatggtatata

SEQ ID NO: 11695 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
gtgtagtcaatgcctaaaaa

SEQ ID NO: 11696 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
atgcctaaaaatagggtaag

SEQ ID NO: 11697 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aagtaagttgtttattctat

SEQ ID NO: 11698 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
cattttgaagactcatgatt

SEQ ID NO: 11699 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aatcacaattgtactgaaga

SEQ ID NO: 11700 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aattgtactgaagagagaat

SEQ ID NO: 11701 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
aaccagtatccaaaagaaat

SEQ ID NO: 11702 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
gctcctccatgaccttagat

SEQ ID NO: 11703 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tctataaatatgtttactct

SEQ ID NO: 11704 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
cgatgtctaagaaaaatgtc

SEQ ID NO: 11705 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
ctggaatgcagttcttcatt

SEQ ID NO: 11706 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gagattcaatttttcgaggg

SEQ ID NO: 11707 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tcctaaagctacgtatttag

SEQ ID NO: 11708 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttttaatgttttgctgtggt

SEQ ID NO: 11709 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gtcatgaaggttctgccttc

SEQ ID NO: 11710 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
gaaggttctgccttcatgaa

SEQ ID NO: 11711 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ctgccttcatgaatggaata

SEQ ID NO: 11712 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
gaatatagagtaagggctta

SEQ ID NO: 11713 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
agggcttaatgggttatcat

SEQ ID NO: 11714 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
cttaatgggttatcatggga

SEQ ID NO: 11715 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gggagtgagttagatatcac

SEQ ID NO: 11716 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
gtgagttagatatcacaaga

SEQ ID NO: 11717 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttaagaaataaatttcttta

SEQ ID NO: 11718 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
gttctccaagccactgttaa

SEQ ID NO: 11719 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGAAT
gttaagtgagttttatgaca

SEQ ID NO: 11720 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ctatggtatagtttgtaact

SEQ ID NO: 11721 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aaatcagacaagtccattct

SEQ ID NO: 11722 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aatataagtagttctgaaat

SEQ ID NO: 11723 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tctgaaatctgaatatacaa

SEQ ID NO: 11724 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tgatttgccacatccaaccc

SEQ ID NO: 11725 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
gtttctgattcagtatgtct

SEQ ID NO: 11726 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gtatgtcttggggttggggg

SEQ ID NO: 11727 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
gggcagaatttgcatctctt

SEQ ID NO: 11728 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaatttgcatctctgtcagc

SEQ ID NO: 11729 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tattaaataatatttcaaat

SEQ ID NO: 11730 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aacaggaggttatactcact

SEQ ID NO: 11731 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gtaaaccttcatttcttaca

SEQ ID NO: 11732 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tcttacactgaatgatgaaa

SEQ ID NO: 11733 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gtaactagataacttgatat

SEQ ID NO: 11734 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
atcattactatatccgaagt

SEQ ID NO: 11735 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tattattattttttttgaga

SEQ ID NO: 11736 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tctcaccctgtcgcccaagc

SEQ ID NO: 11737 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGGT
ctcactgaaacctctgccta

SEQ ID NO: 11738 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
gattcttctgcctcagcctc

SEQ ID NO: 11739 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gcctcagcctcctgagtagc

SEQ ID NO: 11740 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGGT
tttgtattttttagtagaga

SEQ ID NO: 11741 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gcctcggactctcaaagtgc

SEQ ID NO: 11742 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
agccaaaagtttatgaagct

SEQ ID NO: 11743 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
acagttgagaaattgaactt

SEQ ID NO: 11744 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
taatccacatatgatgctgt

SEQ ID NO: 11745 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
ctaaaaactatgactgatta

SEQ ID NO: 11746 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttaggtttctgaaaatctag

SEQ ID NO: 11747 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ttattaaaatataaaataat

SEQ ID NO: 11748 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
cattcaatgaaatgataata

SEQ ID NO: 11749 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tgtaccgttagtttctattt

SEQ ID NO: 11750 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttaaaataatatgtaaacta

SEQ ID NO: 11751 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tccaagtattcaacagttct

SEQ ID NO: 11752 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
cattttggtttttcctataa

SEQ ID NO: 11753 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttatcttccaattttacatt

SEQ ID NO: 11754 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aattttgttttattcttaac

SEQ ID NO: 11755 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ggctgtgttaatatttctaa

SEQ ID NO: 11756 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gttttttcacaacacacagt

SEQ ID NO: 11757 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
atccattttagaagcatttc

SEQ ID NO: 11758 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aagatcttgtctgcatactc

SEQ ID NO: 11759 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gaggtcaagagaaagtgcaa

SEQ ID NO: 11760 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ctcctctttctccattaaaa

SEQ ID NO: 11761 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
ctcccctttttccccaccag

SEQ ID NO: 11762 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ggaaaggaaagatttgctaa

SEQ ID NO: 11763 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
taataggcctatagaacaca

SEQ ID NO: 11764 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
gccacaacacagtgaaagga

SEQ ID NO: 11765 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cagccacatgtcccttgaca

SEQ ID NO: 11766 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tcgaaacactattaaccctg

SEQ ID NO: 11767 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gacaagttggggcagaaaga

SEQ ID NO: 11768 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
gcagaggttctgaaattcaa

SEQ ID NO: 11769 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
agagggaggcttctagccct

SEQ ID NO: 11770 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
actccacccccaaattctgg

SEQ ID NO: 11771 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
ctgtttctagaactggtgta

SEQ ID NO: 11772 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tctctgactggtcccagagc

SEQ ID NO: 11773 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
actggtcccagagcaggaat

SEQ ID NO: 11774 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
ggaattagaattcagcccac

SEQ ID NO: 11775 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
tagcttccagaaccaatttt

SEQ ID NO: 11776 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ggatgtaggagcaaggaggc

SEQ ID NO: 11777 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
agcaaaatatcataatctca

SEQ ID NO: 11778 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
ttaacttttattttaggttt

SEQ ID NO: 11779 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
cataggtaaacacgtgtcat

SEQ ID NO: 11780 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tttatttaaaatacactttt

SEQ ID NO: 11781 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgttttagacattttgaaca

SEQ ID NO: 11782 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
tgaaattctcagtcacatat

SEQ ID NO: 11783 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gtcacatatgtgagtcagca

SEQ ID NO: 11784 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gataaacctccttagttact

SEQ ID NO: 11785 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
gacactatcatgatttctac

SEQ ID NO: 11786 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tgatcacattttctgtttct

SEQ ID NO: 11787 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
gataggaaaggaaagccaca

SEQ ID NO: 11788 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
tgggtccctgcaggttgttg

SEQ ID NO: 11789 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aggttgttggggagtgtgcc

SEQ ID NO: 11790 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
tccttacctaggacattcct

SEQ ID NO: 11791 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
agcaaccttgagacatgagg

SEQ ID NO: 11792 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
agggtctctgggacaaagag

SEQ ID NO: 11793 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
gcttatgttgcttggtataa

SEQ ID NO: 11794 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
atataatgcccccatgagac

SEQ ID NO: 11795 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tgaggcaagttacaaagttc

SEQ ID NO: 11796 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gaagctgcttgtatgtgtac

SEQ ID NO: 11797 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gttcagcagtttttaatttc

SEQ ID NO: 11798 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tccattgctctgagctcctt

SEQ ID NO: 11799 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tccttaagaataaacagtac

SEQ ID NO: 11800 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
gtgaaagttgatcatacaaa

SEQ ID NO: 11801 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tactcaactaacagtcaact

SEQ ID NO: 11802 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
aaggcagggggaaaagctct

SEQ ID NO: 11803 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agggtacaaaacattactcc

SEQ ID NO: 11804 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctcttttctattatagccat

SEQ ID NO: 11805 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
acaacagcattcagggcagc

SEQ ID NO: 11806 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
aaggataatgcctggcatgt

SEQ ID NO: 11807 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ttgtcattggcactaatcat

SEQ ID NO: 11808 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttatcttttagctcatttta

SEQ ID NO: 11809 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
accagggcaccactgctgag

SEQ ID NO: 11810 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gcatgttaaatcttgatatt

SEQ ID NO: 11811 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
caatttcagatagatttaat

SEQ ID NO: 11812 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
aaaccactttcattttatgt

SEQ ID NO: 11813 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
cactttcattttatgtgtga

SEQ ID NO: 11814 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttcattttatgtgtgaatga

SEQ ID NO: 11815 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aactaaaatctgaagacgac

SEQ ID NO: 11816 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tctgaagacgacatgaattt

SEQ ID NO: 11817 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tacatgatttcctttcctca

SEQ ID NO: 11818 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
caactaaagtgacagatagt

SEQ ID NO: 11819 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
cttcctagaagagatggagc

SEQ ID NO: 11820 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tagaagagatggagcctggg

SEQ ID NO: 11821 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gaatcaaaatatcagtaaaa

SEQ ID NO: 11822 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
aaatatcagtaaaaaagagt

SEQ ID NO: 11823 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tcagtaaaaaagagtttggg

SEQ ID NO: 11824 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
catagaaatttaaaccagtt

SEQ ID NO: 11825 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gtttagaattgtgatgcaag

SEQ ID NO: 11826 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
gcagaatgtacacaagaggc

SEQ ID NO: 11827 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
aagcattggcctttacctta

SEQ ID NO: 11828 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cttatatcctattgaggttg

SEQ ID NO: 11829 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ttgaggttgaggagtaagta

SEQ ID NO: 11830 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
agatgtctccacggtacatg

SEQ ID NO: 11831 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
gtacatggaggataagttgg

SEQ ID NO: 11832 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
atggaggataagttggaagg

SEQ ID NO: 11833 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
agttggaagggtgaatagag

SEQ ID NO: 11834 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
aagggtgaatagagaggagt

SEQ ID NO: 11835 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tttcatacccagaaaaccat

SEQ ID NO: 11836 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gggaaagattagttaggaac

SEQ ID NO: 11837 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tatttggcagataaaatcag

SEQ ID NO: 11838 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
cagcaggatttggtgattga

SEQ ID NO: 11839 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tatcaaatgtaagagaaagg

SEQ ID NO: 11840 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
aaggatcccaggactaccag

SEQ ID NO: 11841 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ctaccaggtggatgttagca

SEQ ID NO: 11842 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gtaatgattttgagatgcct

SEQ ID NO: 11843 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
atcctatagattttaaaaat

SEQ ID NO: 11844 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cgggaaaaacctgtctagaa

SEQ ID NO: 11845 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
agtttttgaggtcacacaaa

SEQ ID NO: 11846 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
ggtcacacaaaaagagtatt

SEQ ID NO: 11847 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gaaacaacaatattaaggga

SEQ ID NO: 11848 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatatttgactatataaact

SEQ ID NO: 11849 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
attttatttgtctattccgt

SEQ ID NO: 11850 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tggacggtggtctattctct

SEQ ID NO: 11851 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ctactgtgcaactcttcttt

SEQ ID NO: 11852 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ttctatctggcctattctat

SEQ ID NO: 11853 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tgtcacactgttgagctact

SEQ ID NO: 11854 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
agtttgaaatcagtgatggt

SEQ ID NO: 11855 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
atgagagcttcttgattttc

SEQ ID NO: 11856 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agcttcttgattttctagag

SEQ ID NO: 11857 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttgtgtttgtagccattact

SEQ ID NO: 11858 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aataattgcttacatcactg

SEQ ID NO: 11859 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
attgcttacatcactgatga

SEQ ID NO: 11860 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ttgagaaacaatttgatata

SEQ ID NO: 11861 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
agatgaacaagaaggaccaa

SEQ ID NO: 11862 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gtgcagtaaaagagaaacca

SEQ ID NO: 11863 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gaacataagaggcccagaaa

SEQ ID NO: 11864 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttaaagtttattaaagcaac

SEQ ID NO: 11865 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ctctttaaaaagtaactaca

SEQ ID NO: 11866 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaggcaggaggtgggaaagt

SEQ ID NO: 11867 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttgatacctgtttcagaagt

SEQ ID NO: 11868 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
atataattcattaacaagta

SEQ ID NO: 11869 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
atgttctaaaacaacaaaac

SEQ ID NO: 11870 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ctggtagaaaatgttttgta

SEQ ID NO: 11871 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aagttcccagaagactcaaa

SEQ ID NO: 11872 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aaaagacttgattccccaaa

SEQ ID NO: 11873 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
atttgaaaggttacatctct

SEQ ID NO: 11874 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ttctatactttacataaaca

SEQ ID NO: 11875 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gatgaaaaagaaaaaaaaag

SEQ ID NO: 11876 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tcgataaaatgatataaaaa

SEQ ID NO: 11877 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
atgatataaaaacagagtaa

SEQ ID NO: 11878 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
ataaaaacagagtaaaaggg

SEQ ID NO: 11879 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gagagagcgaaaaaaatgag

SEQ ID NO: 11880 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttaatattaacttagtgctt

SEQ ID NO: 11881 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aacaatgatcacatataaga

SEQ ID NO: 11882 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tctttctcaggggcaaatta

SEQ ID NO: 11883 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gttaagaagattttgctctc

SEQ ID NO: 11884 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
agtttcataaatattgccct

SEQ ID NO: 11885 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tcagggtttattacacctca

SEQ ID NO: 11886 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tctttctcttattttgaggc

SEQ ID NO: 11887 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ctctttaaaaggactattaa

SEQ ID NO: 11888 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aattgaatgtaaacataaca

SEQ ID NO: 11889 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
agaatctctcaaacatttta

SEQ ID NO: 11890 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
aaacattttaatgggtccca

SEQ ID NO: 11891 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
gtgagtaaatgctatttctt

SEQ ID NO: 11892 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tgcattacataaagtctatg

SEQ ID NO: 11893 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
agaaaaaataaaagtcacaa

SEQ ID NO: 11894 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ggttattgtgttactaaagt

SEQ ID NO: 11895 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
tattagttattttataggaa

SEQ ID NO: 11896 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
agttattttataggaagggg

SEQ ID NO: 11897 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
accattattattttttgaga

SEQ ID NO: 11898 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gtctcactttgttgccaggc

SEQ ID NO: 11899 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
gccaggctggagtgcagtag

SEQ ID NO: 11900 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctcactgcaacctctgcctc

SEQ ID NO: 11901 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
gattctcctgcctcagcctc

SEQ ID NO: 11902 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGAT
ttttgtatttttagtagaaa

SEQ ID NO: 11903 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
cgggatttcaccatgttagc

SEQ ID NO: 11904 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tataaaaccacatagaccca

SEQ ID NO: 11905 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ttgccaagtcatgtagaact

SEQ ID NO: 11906 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gcataagagggagagaaaag

SEQ ID NO: 11907 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gtgataattatgaagctgaa

SEQ ID NO: 11908 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
cttcagtaaaaacatgctac

SEQ ID NO: 11909 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aagctcccatcacctctcac

SEQ ID NO: 11910 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
atttgtttgtttgttggaga

SEQ ID NO: 11911 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tcttcctctgtcgtccaggc

SEQ ID NO: 11912 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ctcactgcaacctctgcctc

SEQ ID NO: 11913 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gcctcagcctcacaagtagc

SEQ ID NO: 11914 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tttttcattttcagtaaaaa

SEQ ID NO: 11915 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
acctcggcctcccaaagtac

SEQ ID NO: 11916 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
cttgatatgtttcttcagca

SEQ ID NO: 11917 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tttaataattatttgtttac

SEQ ID NO: 11918 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
attatttgtttactggaata

SEQ ID NO: 11919 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ctggaataaagaatgattat

SEQ ID NO: 11920 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
taagcaaattggctgcttca

SEQ ID NO: 11921 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tctctgctggagcacataaa

SEQ ID NO: 11922 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ctggcctcagtttggaagca

SEQ ID NO: 11923 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ttggaagcaatgaataatct

SEQ ID NO: 11924 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
agtattttcattgatgttta

SEQ ID NO: 11925 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
atagtattaatactttctgt

SEQ ID NO: 11926 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
caacttctttctagttatcc

SEQ ID NO: 11927 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aagtcatgatcattcataaa

SEQ ID NO: 11928 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aagcacaaaatttatattga

SEQ ID NO: 11929 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ccaatcattttgcttaaccc

SEQ ID NO: 11930 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
tttcaaaaaatactaatgct

SEQ ID NO: 11931 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cttctgtataagattgttaa

SEQ ID NO: 11932 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gattgttaacagaatccttg

SEQ ID NO: 11933 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
cctcttagcatcgctgtgat

SEQ ID NO: 11934 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cagcatatcagaaagcatac

SEQ ID NO: 11935 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
cagactttaccctagaggcc

SEQ ID NO: 11936 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aagggcttgggccctatctc

SEQ ID NO: 11937 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
tgactagcaaggaaaacttt

SEQ ID NO: 11938 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
tctctcaaagtctttagctt

SEQ ID NO: 11939 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aaaaaaaaacttattaaact

SEQ ID NO: 11940 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
acagatggtgatgaccaatg

SEQ ID NO: 11941 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tgtaagcagatctgggactc

SEQ ID NO: 11942 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gaggtaaagacattgatgtt

SEQ ID NO: 11943 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
catgaaacacctcagagctt

SEQ ID NO: 11944 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tggggagaaatcattattta

SEQ ID NO: 11945 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cctctgaaactaaggaaagg

SEQ ID NO: 11946 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
acagtatcaaacagttttct

SEQ ID NO: 11947 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
aaacagttttctgagagtta

SEQ ID NO: 11948 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ccatttttgattaaaaggac

SEQ ID NO: 11949 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
tctggtggttccattgatct

SEQ ID NO: 11950 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
ggttccattgatctgggaat

SEQ ID NO: 11951 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
taatcatcatacagctatag

SEQ ID NO: 11952 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
cagctatagctgaatcagca

SEQ ID NO: 11953 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
atagctgaatcagcatggaa

SEQ ID NO: 11954 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aaaccccagaacactaatta

SEQ ID NO: 11955 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGAAT
gaaacaggcctctggctcat

SEQ ID NO: 11956 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ttcttctccttctccaggca

SEQ ID NO: 11957 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gaccggtttaatctctagaa

SEQ ID NO: 11958 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
accccaccaggtagttcatt

SEQ ID NO: 11959 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aatgtattttttattatctc

SEQ ID NO: 11960 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
ttgaatttaaatatatgtag

SEQ ID NO: 11961 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aaacatggcagacttacaca

SEQ ID NO: 11962 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gcagacttacacatggaata

SEQ ID NO: 11963 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tttttctcacccagagcttt

SEQ ID NO: 11964 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
tcccaaatattgttttataa

SEQ ID NO: 11965 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gtaaagcagcatatcaatgg

SEQ ID NO: 11966 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tctcatttgctaaatgacat

SEQ ID NO: 11967 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
agttacaactttatcttttt

SEQ ID NO: 11968 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gataaattgattctcaatct

SEQ ID NO: 11969 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ggaagctagaagtattcttg

SEQ ID NO: 11970 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tacaacatcataaaaatggc

SEQ ID NO: 11971 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tggataaagtattgtacata

SEQ ID NO: 11972 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gacaatgtctttcttataac

SEQ ID NO: 11973 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
gcattattcccaccaggtcc

SEQ ID NO: 11974 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aaacatgttatttaaactga

SEQ ID NO: 11975 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ataatagaaattaattataa

SEQ ID NO: 11976 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ctgaatattctataaaacta

SEQ ID NO: 11977 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aggctttaaagtataaacta

SEQ ID NO: 11978 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tttaaagtataaactataga

SEQ ID NO: 11979 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
gattaatccaggaaacgatg

SEQ ID NO: 11980 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aggcccttcatttctgaaaa

SEQ ID NO: 11981 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctgaaaaaagaattattggc

SEQ ID NO: 11982 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ttttgaggtaaagcagtgag

SEQ ID NO: 11983 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgagaggaattgctgataga

SEQ ID NO: 11984 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aataaaatgattcttatttg

SEQ ID NO: 11985 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tatgtttttttaatggtcaa

SEQ ID NO: 11986 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
caattgaattcagcttggca

SEQ ID NO: 11987 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
tagacattcaatgttttctt

SEQ ID NO: 11988 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
cttctttagcagatttctaa

SEQ ID NO: 11989 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttttcctgcggtgaaatata

SEQ ID NO: 11990 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
catcaccatatttaagtact

SEQ ID NO: 11991 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ccatgtaattttggaaatga

SEQ ID NO: 11992 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ggaccttctgtaattttcac

SEQ ID NO: 11993 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
agtaaatataaatataagca

SEQ ID NO: 11994 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aaggtggactcactagtatt

SEQ ID NO: 11995 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttagcattcctgccttttta

SEQ ID NO: 11996 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tgtgttttctactatactgc

SEQ ID NO: 11997 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
taagcctatttcatgctatc

SEQ ID NO: 11998 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
tgttccaagaggtgtgaggt

SEQ ID NO: 11999 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
caacaaaaaccttactcaaa

SEQ ID NO: 12000 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
attctttaaggagcagagcc

SEQ ID NO: 12001 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aagcaaatcaaaaggaggag

SEQ ID NO: 12002 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
caatatctataattgtgttc

SEQ ID NO: 12003 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
attgtgttcttgaatcatta

SEQ ID NO: 12004 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aaaatagtaaatttcaatta

SEQ ID NO: 12005 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aaatttcaattaaaggatca

SEQ ID NO: 12006 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
acatagttactatgtggcat

SEQ ID NO: 12007 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
atgtgaacattatcctctta

SEQ ID NO: 12008 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tactattagtgcttttcatc

SEQ ID NO: 12009 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ttaaaaaatcactgaagctc

SEQ ID NO: 12010 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aatattgtgtaggctctggg

SEQ ID NO: 12011 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cagccaccaccagagaaatt

SEQ ID NO: 12012 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cggagacctcttctttttct

SEQ ID NO: 12013 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
acgtgactaaatgataagat

SEQ ID NO: 12014 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
aagaagagaagcaaagagct

SEQ ID NO: 12015 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ctgtttgcagagaaagcagc

SEQ ID NO: 12016 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
gagaaagcagctggaataca

SEQ ID NO: 12017 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tggaatacagtgggtcaagt

SEQ ID NO: 12018 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aatgcaacaagtaggtaaag

SEQ ID NO: 12019 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tctataattttgaaacaaac

SEQ ID NO: 12020 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aaagtaagctacctagatat

SEQ ID NO: 12021 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
atgaaggagggcaaggaaaa

SEQ ID NO: 12022 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gcaaggaaaagtgaatttta

SEQ ID NO: 12023 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
gaaaagtgaattttaatgaa

SEQ ID NO: 12024 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
attactagctttttaaacat

SEQ ID NO: 12025 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
aatataaatagaaattttac

SEQ ID NO: 12026 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
atatttcaagtcattcttaa

SEQ ID NO: 12027 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
atattcagtttttttcttaa

SEQ ID NO: 12028 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cagcttggtaaaaaagtaat

SEQ ID NO: 12029 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
taaaaaagtaataagaattt

SEQ ID NO: 12030 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ctatacctatatagataata

SEQ ID NO: 12031 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
gaagaaaattcaccatattc

SEQ ID NO: 12032 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ggaataaaatagttttctat

SEQ ID NO: 12033 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tctctaaggtgtgtcaattt

SEQ ID NO: 12034 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
atatgaactagattataaaa

SEQ ID NO: 12035 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
ttctatgtgttattgataga

SEQ ID NO: 12036 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tcagaaacttattcttatca

SEQ ID NO: 12037 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tcaatgagtaatattacttc

SEQ ID NO: 12038 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
ataaaatcaaatgttaatta

SEQ ID NO: 12039 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
ttcaaagtttatactagaag

SEQ ID NO: 12040 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tagatgtgtactaagaaagc

SEQ ID NO: 12041 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cttatccataaatacataac

SEQ ID NO: 12042 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agaattattaaatacaaagc

SEQ ID NO: 12043 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
acacttcttccacaattttt

SEQ ID NO: 12044 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttacatcaagaagtcatcaa

SEQ ID NO: 12045 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
tatgtttctactttcttgca

SEQ ID NO: 12046 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgtgagaagaaggttaggta

SEQ ID NO: 12047 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttagaaatgcagcatgatga

SEQ ID NO: 12048 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ctcaacgttaagcaatatat

SEQ ID NO: 12049 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tctactctactatttaaaaa

SEQ ID NO: 12050 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
tataagtgattctcagtata

SEQ ID NO: 12051 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
atagggggtgaggtggcagt

SEQ ID NO: 12052 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tccaaatttatcaaaatata

SEQ ID NO: 12053 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aaagaataagacacattgat

SEQ ID NO: 12054 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gtctaagtgcaattctacag

SEQ ID NO: 12055 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaaaatctatgcataaaata

SEQ ID NO: 12056 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
atgactttgtaaactgaaca

SEQ ID NO: 12057 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gtaaactgaacactgaatag

SEQ ID NO: 12058 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
actgaacactgaatagatga

SEQ ID NO: 12059 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
aacactgaatagatgaatgg

SEQ ID NO: 12060 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atagatgaatgggtggatag

SEQ ID NO: 12061 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atgaatgggtggatagatga

SEQ ID NO: 12062 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
atgggtggatagatgaatga

SEQ ID NO: 12063 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gtggatagatgaatgaatga

SEQ ID NO: 12064 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gagtgaatcaggtgaacaat

SEQ ID NO: 12065 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGAT
gactagtttagtgtcctgtt

SEQ ID NO: 12066 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ttacctaaggtgcaagctat

SEQ ID NO: 12067 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tagggggccaaaaatatttc

SEQ ID NO: 12068 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
gcctattataattctgggca

SEQ ID NO: 12069 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
actatgcacaaataaaagaa

SEQ ID NO: 12070 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aagaaataagattatacagg

SEQ ID NO: 12071 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tttttgcagattaaaaatgg

SEQ ID NO: 12072 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ttcttttgacattttcataa

SEQ ID NO: 12073 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
cttccaaggtatcttaccaa

SEQ ID NO: 12074 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
aagagaatccagattttatt

SEQ ID NO: 12075 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
agccaggctaccttgttgtt

SEQ ID NO: 12076 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
caataagacataagccaaag

SEQ ID NO: 12077 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
gacataagccaaagttggat

SEQ ID NO: 12078 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tttgcccttcctcaggcaag

SEQ ID NO: 12079 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
cgttctatttctttctctac

SEQ ID NO: 12080 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tttctttctctacctgggta

SEQ ID NO: 12081 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
gccacgtggactgctgatct

SEQ ID NO: 12082 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gatgttttaaaatatgaaaa

SEQ ID NO: 12083 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ctctgttgcatgcagttaaa

SEQ ID NO: 12084 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aaacacacacacaaaaaaat

SEQ ID NO: 12085 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tctggactttagtgatattt

SEQ ID NO: 12086 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
catcaacaagccagggagag

SEQ ID NO: 12087 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agcaaggttttcacctagag

SEQ ID NO: 12088 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aggttttcacctagagaaga

SEQ ID NO: 12089 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
caggcagaagctacaagaac

SEQ ID NO: 12090 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
agaacttgaatttggtctag

SEQ ID NO: 12091 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tataaaatatgcatttaata

SEQ ID NO: 12092 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
tactgaataaatggaaagga

SEQ ID NO: 12093 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
ttttacttttcaataaagaa

SEQ ID NO: 12094 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
cctaatcagtcagcattaag

SEQ ID NO: 12095 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gtggattagaagcacaatat

SEQ ID NO: 12096 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
agcacaatatcagaatccca

SEQ ID NO: 12097 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttacaacagaaaatttcacc

SEQ ID NO: 12098 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
gtagtataatgattacagct

SEQ ID NO: 12099 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
caaatcttttcttaatcttt

SEQ ID NO: 12100 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tcccccagctgccaaaagtg

SEQ ID NO: 12101 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tggatgctgaaggctcacat

SEQ ID NO: 12102 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aaagggagagcctgcatcca

SEQ ID NO: 12103 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
tttgttttggaactactcca

SEQ ID NO: 12104 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
cacagcatcagagatgccaa

SEQ ID NO: 12105 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
taaatctcagatttctctct

SEQ ID NO: 12106 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
ctaagtcaaaattctttgtt

SEQ ID NO: 12107 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tcaaaattctttgttgtggg

SEQ ID NO: 12108 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
aagtcctaaccctggcatgt

SEQ ID NO: 12109 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
aatgaagatgaggtcattgt

SEQ ID NO: 12110 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
gggtccaaatccaatataac

SEQ ID NO: 12111 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
acacacagggagaaaactac

SEQ ID NO: 12112 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gtgagtaccgggccagagat

SEQ ID NO: 12113 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
atgatgcagctgcaagctgc

SEQ ID NO: 12114 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aaagttagaaagcagcaagg

SEQ ID NO: 12115 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ctagcctccagaactggcaa

SEQ ID NO: 12116 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
atttctgttgttgtaagcca

SEQ ID NO: 12117 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
cgtaagaaactaatacatcc

SEQ ID NO: 12118 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
taataaatatttattgacaa

SEQ ID NO: 12119 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tgtagtgtgttgttaatgtt

SEQ ID NO: 12120 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gcattcttagaaacagtgaa

SEQ ID NO: 12121 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
gtgaaaagagtattattctc

SEQ ID NO: 12122 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
aaaatattttgatttgattc

SEQ ID NO: 12123 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
cataaactctgttgagaaac

SEQ ID NO: 12124 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
ggatgctaggtcataaaaga

SEQ ID NO: 12125 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ggtcataaaagagagggttt

SEQ ID NO: 12126 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gggaaatatacccatagccc

SEQ ID NO: 12127 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gaaaataatatctcagaaac

SEQ ID NO: 12128 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aacctgaatccaagtaagct

SEQ ID NO: 12129 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
ataataattgtacatattta

SEQ ID NO: 12130 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tacattatataattatcaaa

SEQ ID NO: 12131 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
attcatgttgccacaaataa

SEQ ID NO: 12132 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gatttcattatttcttatgg

SEQ ID NO: 12133 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cagtgcagcaataaacatat

SEQ ID NO: 12134 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
acatactgatttcatttcat

SEQ ID NO: 12135 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tttacttagtattgggactg

SEQ ID NO: 12136 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
cattctcacaatcagtgtgt

SEQ ID NO: 12137 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
ttgatggtagccattttaac

SEQ ID NO: 12138 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttcaggtcttttgtccattt

SEQ ID NO: 12139 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
atttgttttttttgtcgttg

SEQ ID NO: 12140 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ttttgtcgttgttgagttgt

SEQ ID NO: 12141 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ttacatttaagtagtctatt

SEQ ID NO: 12142 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tccaggttacttgggctatt

SEQ ID NO: 12143 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tttttttttttttttctgta

SEQ ID NO: 12144 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aatgtcactggtattttgat

SEQ ID NO: 12145 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
cattaaacctgtagattgct

SEQ ID NO: 12146 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
attattctaatccatgaaca

SEQ ID NO: 12147 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
ttttttgtagctattgtaaa

SEQ ID NO: 12148 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttttgtgtcctccaacatta

SEQ ID NO: 12149 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
aaatctactactttttttca

SEQ ID NO: 12150 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tcagatcatataaaaacaaa

SEQ ID NO: 12151 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gctagaacttcattactatg

SEQ ID NO: 12152 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
tggttagtatcatgttagct

SEQ ID NO: 12153 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ttgataatttttatcaaata

SEQ ID NO: 12154 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tttttatcaaataaaggata

SEQ ID NO: 12155 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
acgatttccagttgagcatg

SEQ ID NO: 12156 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ataatctttttgataggctg

SEQ ID NO: 12157 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tttttgataggctgttggat

SEQ ID NO: 12158 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
attttgcatctgtgttcatc

SEQ ID NO: 12159 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tccctgtcttgttctggtat

SEQ ID NO: 12160 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttggggtaatattggccttg

SEQ ID NO: 12161 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ggtaatattggccttgtaga

SEQ ID NO: 12162 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gccttgtagaatgaatttag

SEQ ID NO: 12163 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tcctttccttttgatttttt

SEQ ID NO: 12164 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tttttttggaataatttaag

SEQ ID NO: 12165 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gttcttctttaaatgtttgg

SEQ ID NO: 12166 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
gttactcattattggtctgt

SEQ ID NO: 12167 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
gtcttggcaagttgtatgtg

SEQ ID NO: 12168 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
cattaggttttccaatttgt

SEQ ID NO: 12169 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aaatttaggcaaacaattca

SEQ ID NO: 12170 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gcatttgtctaattatttat

SEQ ID NO: 12171 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
atgacataaatatataaatt

SEQ ID NO: 12172 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
aaattaggagttactttcta

SEQ ID NO: 12173 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
aaaataaaagttgcaaaaga

SEQ ID NO: 12174 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aagtgggagatgaagattat

SEQ ID NO: 12175 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
agcaggaaaagttagcatag

SEQ ID NO: 12176 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
atgtacactattttagtgat

SEQ ID NO: 12177 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
acaaaacaaaacaaaaatga

SEQ ID NO: 12178 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
atggaaaattttttatgaag

SEQ ID NO: 12179 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aagtcagtagcactaagaac

SEQ ID NO: 12180 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tgcataccatggaaatgtaa

SEQ ID NO: 12181 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ccatggaaatgtaatagagt

SEQ ID NO: 12182 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gaaaaaaattagtgaaaatc

SEQ ID NO: 12183 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttagtgaaaatcaagaatat

SEQ ID NO: 12184 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tacgctttcggaagggctca

SEQ ID NO: 12185 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
agggctcatggaataagtga

SEQ ID NO: 12186 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ataagtgacagagtaatttt

SEQ ID NO: 12187 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gacaaattattaagtccaat

SEQ ID NO: 12188 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ataactctagctttataact

SEQ ID NO: 12189 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aataaaatcacttcctttta

SEQ ID NO: 12190 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atgttgcaactcaacatact

SEQ ID NO: 12191 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
caactcaacatactaagaat

SEQ ID NO: 12192 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tcctgaagtgctttaacacc

SEQ ID NO: 12193 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gcaactgtctgccaggcaat

SEQ ID NO: 12194 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ataattttaatcttctttaa

SEQ ID NO: 12195 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aatcttctttaaatgggtga

SEQ ID NO: 12196 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
agttagaaaaaaataggtga

SEQ ID NO: 12197 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tgctccttaaaaggcatacg

SEQ ID NO: 12198 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
gaacacggttttaaaatttt

SEQ ID NO: 12199 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
acagctggccttctgtatcc

SEQ ID NO: 12200 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
atccctgggtcccacatctg

SEQ ID NO: 12201 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aatttaaagtgtacatatga

SEQ ID NO: 12202 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
cattgtgccattttatataa

SEQ ID NO: 12203 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ctactcgcccatagatatcg

SEQ ID NO: 12204 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tgtattgattttttttgaga

SEQ ID NO: 12205 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tctcactctgtagtccaagc

SEQ ID NO: 12206 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
aagtccactataaattcatg

SEQ ID NO: 12207 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
cactataaattcatggaggg

SEQ ID NO: 12208 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ctcactagaaatatgcaggt

SEQ ID NO: 12209 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gggcacaaaaaaaggtttta

SEQ ID NO: 12210 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttaaagagttcctgttctca

SEQ ID NO: 12211 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aaaattaaaatttaagatta

SEQ ID NO: 12212 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ccatttggggagaaattagg

SEQ ID NO: 12213 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
taaataacattttgagaaca

SEQ ID NO: 12214 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
atttaatagatgataaatac

SEQ ID NO: 12215 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aatacaagggtgatgccttg

SEQ ID NO: 12216 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
gaaatcccaagcaaagtgtg

SEQ ID NO: 12217 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
tttggtacaggtaaaaatct

SEQ ID NO: 12218 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
agtacataattcgagacttt

SEQ ID NO: 12219 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gcaactggggaaaaagtttg

SEQ ID NO: 12220 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
gaaaaagtttgaagaattgc

SEQ ID NO: 12221 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
aacttttttaaaaaaattag

SEQ ID NO: 12222 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aattagctgggtgttgtggc

SEQ ID NO: 12223 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aactcaggaggtggaggcag

SEQ ID NO: 12224 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
caggaggatcacttgagccc

SEQ ID NO: 12225 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ctgtactccagactgggcaa

SEQ ID NO: 12226 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGAT
gagagagagagcgatacttt

SEQ ID NO: 12227 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
agagcgatactttgcggatc

SEQ ID NO: 12228 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
gcggatcatggatacatcat

SEQ ID NO: 12229 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgagagtgaaatgattagga

SEQ ID NO: 12230 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
aaataatcaaataagtaaac

SEQ ID NO: 12231 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
aatggtttaggcaaaaagta

SEQ ID NO: 12232 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
aaaggtgatgaaaaggagag

SEQ ID NO: 12233 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
ttttcaactgacaggaaaca

SEQ ID NO: 12234 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tagtaagaaaactttaccag

SEQ ID NO: 12235 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAAT
cactttgctgtattcactat

SEQ ID NO: 12236 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGGAT
cagcattcatattttccaaa

SEQ ID NO: 12237 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tggcactgtcactgtgaggc

SEQ ID NO: 12238 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gtcactgtgaggctgggatt

SEQ ID NO: 12239 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ggctttttggaaaatgcttt

SEQ ID NO: 12240 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
aatctggaggttgtttgcat

SEQ ID NO: 12241 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
aataggtttaggacctatat

SEQ ID NO: 12242 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
cctatatcagggtggggaga

SEQ ID NO: 12243 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAAT
aataaaataagtacactttt

SEQ ID NO: 12244 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGAT
atttctgcaccttttcacac

SEQ ID NO: 12245 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
cacatgagagagacagaggc

SEQ ID NO: 12246 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
cccctgcagactcagcagca

SEQ ID NO: 12247 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gagggtcagccatacccagg

SEQ ID NO: 12248 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gaattaccatggggagcaga

SEQ ID NO: 12249 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
attctgtccaagaagcgtgc

SEQ ID NO: 12250 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
cttgaagcaaagttttattt

SEQ ID NO: 12251 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ccaggaaacaaaaaaggaaa

SEQ ID NO: 12252 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
attctggaggtcggaggtct

SEQ ID NO: 12253 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ttgtgtatatttgttttaat

SEQ ID NO: 12254 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
aggaatattggtgaagatct

SEQ ID NO: 12255 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
caagcgttaaaccattttaa

SEQ ID NO: 12256 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
tctaatatttctataaccta

SEQ ID NO: 12257 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
actggcaataaaatgatcaa

SEQ ID NO: 12258 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ctaatgtggaaggctatatc

SEQ ID NO: 12259 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tggtagttcctccattagtc

SEQ ID NO: 12260 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aagagttggttatcaacttt

SEQ ID NO: 12261 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttctgtatactttctttgcc

SEQ ID NO: 12262 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttgccaagaattaataatta

SEQ ID NO: 12263 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aataattaaagaataataat

SEQ ID NO: 12264 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
ttagttaacactaattctac

SEQ ID NO: 12265 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ctaataagcatcttaaaaac

SEQ ID NO: 12266 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ttaaaaacaaggattagacc

SEQ ID NO: 12267 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
agagaagatactaaaaaata

SEQ ID NO: 12268 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
gaaaatgtggtgagagccaa

SEQ ID NO: 12269 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ccaagggaatgcctttccct

SEQ ID NO: 12270 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gcctttccctttgaatttgc

SEQ ID NO: 12271 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
actttgggaggcgacggagg

SEQ ID NO: 12272 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
aggctggatcacctgaggtc

SEQ ID NO: 12273 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tactcaggaggctgaggcag

SEQ ID NO: 12274 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tgaacctgggaggtggaggt

SEQ ID NO: 12275 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aacagagaagaagaaacaaa

SEQ ID NO: 12276 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gcatttcattccatattgga

SEQ ID NO: 12277 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
cttatttattactacaactt

SEQ ID NO: 12278 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttgagggtgatcaacaatta

SEQ ID NO: 12279 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
acaattatagaatggtaatc

SEQ ID NO: 12280 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttttttgtgcagtaaaaatc

SEQ ID NO: 12281 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
cagtatcatttagtgtgtga

SEQ ID NO: 12282 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atcatttagtgtgtgactgg

SEQ ID NO: 12283 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gtaagtttctgtcctgactt

SEQ ID NO: 12284 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ctgttaccatatcccacctt

SEQ ID NO: 12285 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
caagtcaacgtggcagattt

SEQ ID NO: 12286 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tggcagatttgagaattgag

SEQ ID NO: 12287 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
cagtcatagaagatacgtaa

SEQ ID NO: 12288 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atgaattgacattcctatgt

SEQ ID NO: 12289 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atagaaacctttgccttaaa

SEQ ID NO: 12290 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
tgattttgaaaaatataaat

SEQ ID NO: 12291 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cacgcggaacacaatcagga

SEQ ID NO: 12292 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
gaggttacctagagccccta

SEQ ID NO: 12293 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tcagcatgttcaatgttggc

SEQ ID NO: 12294 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ccaatcttgatttttgttca

SEQ ID NO: 12295 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
gaaactatgtacttttagtt

SEQ ID NO: 12296 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatttgtgatatttttcttt

SEQ ID NO: 12297 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gataaaatctagcatattag

SEQ ID NO: 12298 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
atcagacaacaattgttttg

SEQ ID NO: 12299 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tattagcgtgtacttcaaat

SEQ ID NO: 12300 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttctttaagtgcatttgtca

SEQ ID NO: 12301 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ttaagtgcatttgtcaatga

SEQ ID NO: 12302 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaagaaatacccctttatta

SEQ ID NO: 12303 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
cttagtttatgtttaccagt

SEQ ID NO: 12304 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gcctacttggaaatactcat

SEQ ID NO: 12305 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gtttgctaaatactttataa

SEQ ID NO: 12306 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
atcatttttagacagcattt

SEQ ID NO: 12307 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
atagcatattaaaatttcag

SEQ ID NO: 12308 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgacacagtcactattttca

SEQ ID NO: 12309 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
actattttcaaagaatttat

SEQ ID NO: 12310 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ttttctgatctgactactgt

SEQ ID NO: 12311 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
cttaaaaaggcaacaccgaa

SEQ ID NO: 12312 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
gcaacaccgaaatgaatcct

SEQ ID NO: 12313 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tttgggtacactttgactca

SEQ ID NO: 12314 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
atgtttaggtctataactgc

SEQ ID NO: 12315 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
gagtcaattttcaaataatg

SEQ ID NO: 12316 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tgtgaccaggtaaatccttt

SEQ ID NO: 12317 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
taaatcctttctgagttcac

SEQ ID NO: 12318 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGAT
aaggtacttatttgcaagat

SEQ ID NO: 12319 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaagataaatagaagggaag

SEQ ID NO: 12320 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
agcacatggggaaaaacatt

SEQ ID NO: 12321 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aaagttattcatggtttatg

SEQ ID NO: 12322 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aaactggcattttgtttacc

SEQ ID NO: 12323 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tctggcatcaattttactaa

SEQ ID NO: 12324 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
gatcaccttcttgcctatcc

SEQ ID NO: 12325 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agaaagcatttaatcctccc

SEQ ID NO: 12326 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aatgataaaattaaatacta

SEQ ID NO: 12327 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ggcatatcactcatataatg

SEQ ID NO: 12328 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
atccattcatatggaaagtt

SEQ ID NO: 12329 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
gacaactaaaaagagaaact

SEQ ID NO: 12330 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttcctatagcaagtacattt

SEQ ID NO: 12331 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
atttttgaattcctcagtca

SEQ ID NO: 12332 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ggtaattgcaagatctacaa

SEQ ID NO: 12333 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
caataaaatagatacacttt

SEQ ID NO: 12334 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atggagagcaattccagatc

SEQ ID NO: 12335 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ggagaaaaaagcagagaaca

SEQ ID NO: 12336 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
tgcctagatgaagcataaga

SEQ ID NO: 12337 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tctcaccatttatttaggag

SEQ ID NO: 12338 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
agacactttgcccccacaat

SEQ ID NO: 12339 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
gcccccacaatgggaatgtg

SEQ ID NO: 12340 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
tggggcatattgtcagggga

SEQ ID NO: 12341 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGAAT
ttagaagagacaatttttga

SEQ ID NO: 12342 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tttgtaagattatatagtga

SEQ ID NO: 12343 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
agtgacagaatcacgtagct

SEQ ID NO: 12344 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
atcacccaacatctgtcttt

SEQ ID NO: 12345 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttaaaaccattttatggtct

SEQ ID NO: 12346 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atggtctctgaattcttcct

SEQ ID NO: 12347 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gatttatgttaattttattt

SEQ ID NO: 12348 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
cattgctctctgtctgaggt

SEQ ID NO: 12349 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
atcaattaatgtcttaagaa

SEQ ID NO: 12350 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
atcttgcttatatagctgta

SEQ ID NO: 12351 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
taaaagtagagcctagattg

SEQ ID NO: 12352 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
cagttttatattggtaaaat

SEQ ID NO: 12353 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
tgcttgcttcatattcttgt

SEQ ID NO: 12354 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
catattcttgtgaggattaa

SEQ ID NO: 12355 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
atcatcacctctctgccttt

SEQ ID NO: 12356 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
ctgtagtgctgtgtatctaa

SEQ ID NO: 12357 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gtgctgtgtatctaaagggg

SEQ ID NO: 12358 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
agtattctctgataaatttc

SEQ ID NO: 12359 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aaggaacaattagtgaaatg

SEQ ID NO: 12360 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
atacaggcatagatatgtgc

SEQ ID NO: 12361 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgtgctatagtctgtcaaac

SEQ ID NO: 12362 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
tagttttgtagttttcactt

SEQ ID NO: 12363 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
attgaaatatatgtgtggcc

SEQ ID NO: 12364 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tagcatatgtttgaagctta

SEQ ID NO: 12365 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
tggtaatgcagcatagcata

SEQ ID NO: 12366 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
agagatatcctggaaactcc

SEQ ID NO: 12367 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
actgcacattggagagatag

SEQ ID NO: 12368 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
cacattggagagatagcaga

SEQ ID NO: 12369 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
taggagctaccatttattag

SEQ ID NO: 12370 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
gataataatgtatcatctca

SEQ ID NO: 12371 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
acaactcaaataagattcct

SEQ ID NO: 12372 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tccaaatttcttcatagaaa

SEQ ID NO: 12373 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
caagtacctttttacaaaaa

SEQ ID NO: 12374 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
acaaaaatgggattttatct

SEQ ID NO: 12375 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agttagatgcctacaacaca

SEQ ID NO: 12376 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
atgcctacaacacatagaat

SEQ ID NO: 12377 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atagaatgaggattaggcta

SEQ ID NO: 12378 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tgttactgctgcgtcgctcc

SEQ ID NO: 12379 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
cttgcagaaaacaaggagcc

SEQ ID NO: 12380 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aaaacaaggagccacgaatg

SEQ ID NO: 12381 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aagaaaacttcttccactta

SEQ ID NO: 12382 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttaagggatgaaacaatttg

SEQ ID NO: 12383 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
agctctctaatattctggcc

SEQ ID NO: 12384 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
atgcttatatgactcatgtc

SEQ ID NO: 12385 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ccagggtgtaaatcctttgg

SEQ ID NO: 12386 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttttttactgtgtatatcag

SEQ ID NO: 12387 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tagtttagaaaagtgatttg

SEQ ID NO: 12388 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
cagaagcaatggttcatctt

SEQ ID NO: 12389 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gttcatcttggggatttgtg

SEQ ID NO: 12390 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aaagagaacttccacataaa

SEQ ID NO: 12391 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
tattagtagttgatgtggtt

SEQ ID NO: 12392 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
agttgatgtggttgggggtg

SEQ ID NO: 12393 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aggcttctccaaagttccaa

SEQ ID NO: 12394 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ttctccaaagttccaaatgg

SEQ ID NO: 12395 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tataaaagttattctatagt

SEQ ID NO: 12396 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttctgaaaattagtttatta

SEQ ID NO: 12397 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAGT
aaatcactcactatcctctc

SEQ ID NO: 12398 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGGGT
tttttctctagcattctgcc

SEQ ID NO: 12399 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ggtgatacacatttagcaat

SEQ ID NO: 12400 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
aatttgggtggtacctgatt

SEQ ID NO: 12401 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tagcacttttagagctcagt

SEQ ID NO: 12402 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
gccaagacgttaacacttaa

SEQ ID NO: 12403 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cgttttctttacacaatgat

SEQ ID NO: 12404 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aataaagctctattgtattt

SEQ ID NO: 12405 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aaagttttacaaggtaattt

SEQ ID NO: 12406 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aattaactccatatcatcaa

SEQ ID NO: 12407 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
actctatggtttaataaaga

SEQ ID NO: 12408 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttgagttatttgaaaaataa

SEQ ID NO: 12409 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
ttggcctaaatgaaacttct

SEQ ID NO: 12410 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
ggaattccctaggtagtacc

SEQ ID NO: 12411 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
accattattaaaatgctgca

SEQ ID NO: 12412 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tgcactgaatatttgtgcat

SEQ ID NO: 12413 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cttctcaaacatttacactg

SEQ ID NO: 12414 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ctgaagaatctctctggaaa

SEQ ID NO: 12415 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ggattaaggaggaaactttc

SEQ ID NO: 12416 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gttttagtcataccccatag

SEQ ID NO: 12417 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gtatcaattctagctcagcc

SEQ ID NO: 12418 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
cctttttccacaccagaaat

SEQ ID NO: 12419 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tttgcatttctacctctagg

SEQ ID NO: 12420 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tatgccatggcaaccacagc

SEQ ID NO: 12421 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttaaacacattttcagtacg

SEQ ID NO: 12422 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atcaaatattaataatatca

SEQ ID NO: 12423 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gctttctttgctttttaaaa

SEQ ID NO: 12424 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
attttttttcaaaatagttt

SEQ ID NO: 12425 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ataacgtgcaggtttgttac

SEQ ID NO: 12426 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tcattgcccacctctcactc

SEQ ID NO: 12427 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tgttcctgttttagtttgct

SEQ ID NO: 12428 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
agtctatcattgatgggcat

SEQ ID NO: 12429 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ggttcccagtctttgctatt

SEQ ID NO: 12430 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gtgtgcatgtgtctttacca

SEQ ID NO: 12431 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
atagaatgatatgtaatctt

SEQ ID NO: 12432 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tttgggtatatacccagtaa

SEQ ID NO: 12433 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
tatacccagtaatgggattg

SEQ ID NO: 12434 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gatggtatctcattgtggtt

SEQ ID NO: 12435 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tttttcatatgtttaagtta

SEQ ID NO: 12436 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaattgttcaactcccactt

SEQ ID NO: 12437 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
tcttcctgtattagtttgct

SEQ ID NO: 12438 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
aatttaacattgatgggcat

SEQ ID NO: 12439 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gtgtgcatgtgtctttgtag

SEQ ID NO: 12440 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tttcggtatatacccagtaa

SEQ ID NO: 12441 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tttctggttctaggtcctta

SEQ ID NO: 12442 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ctatttcttcatagcctcac

SEQ ID NO: 12443 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
atcctttgcccactttttga

SEQ ID NO: 12444 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
actccatagccaatatcata

SEQ ID NO: 12445 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tttaaaaactggcacaagac

SEQ ID NO: 12446 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
actgctattcaatatagtgt

SEQ ID NO: 12447 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
tcagacaagagaaagaaata

SEQ ID NO: 12448 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aagcaacttcagcaaggtat

SEQ ID NO: 12449 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gacaagcagagagccaaatc

SEQ ID NO: 12450 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ccatttgcaattgctataaa

SEQ ID NO: 12451 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ataaagagaataaaatacct

SEQ ID NO: 12452 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
acctaggaatacagcttaca

SEQ ID NO: 12453 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tggaaaaacattccatactc

SEQ ID NO: 12454 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
attccatactcatggatagg

SEQ ID NO: 12455 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aattaccattgacatcttca

SEQ ID NO: 12456 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
caaacagacatataggccaa

SEQ ID NO: 12457 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agacatataggccaatggaa

SEQ ID NO: 12458 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
acaaaaacaagcaatgtgga

SEQ ID NO: 12459 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tatacaaaaattaactcaag

SEQ ID NO: 12460 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
ccaaagccaaaattgacaaa

SEQ ID NO: 12461 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
acagcaaaagaaactaacat

SEQ ID NO: 12462 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
cagagtgaacaggcaaacta

SEQ ID NO: 12463 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tctgacaaaggtctaatatt

SEQ ID NO: 12464 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
atcatacaaagcattttaaa

SEQ ID NO: 12465 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
aaagcattttaaagtgaatt

SEQ ID NO: 12466 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ttatttgtgtttctttaatt

SEQ ID NO: 12467 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAAT
aagtgcatcttacataattt

SEQ ID NO: 12468 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ctgcagctattctgagaaaa

SEQ ID NO: 12469 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatcattgttatgtgtacta

SEQ ID NO: 12470 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aagttagaggaaatagccac

SEQ ID NO: 12471 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ggagagaaaaacttagagaa

SEQ ID NO: 12472 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
ttgcatctttaactttaaat

SEQ ID NO: 12473 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
ggtacttaactaggacccca

SEQ ID NO: 12474 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
ctacccatattattagtgat

SEQ ID NO: 12475 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
taattttggtaataagataa

SEQ ID NO: 12476 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
taaaggttttcccagtaatc

SEQ ID NO: 12477 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
aaagctcgtgtagccataat

SEQ ID NO: 12478 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
cgagaaagaacattataggt

SEQ ID NO: 12479 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tcttctatagggggacaata

SEQ ID NO: 12480 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
atagggggacaatattgaat

SEQ ID NO: 12481 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gacaatattgaataaggatt

SEQ ID NO: 12482 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
cataagtctgtctgtgaaaa

SEQ ID NO: 12483 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ctttctgtctgtataattct

SEQ ID NO: 12484 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gtataattcttggaatagat

SEQ ID NO: 12485 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gccagtgtacacagagcctg

SEQ ID NO: 12486 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
agaagcagcaagatggacag

SEQ ID NO: 12487 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aatatgtgtacccaagtcca

SEQ ID NO: 12488 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gtccaaggaatccctttgct

SEQ ID NO: 12489 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aacatgacattcagtcacct

SEQ ID NO: 12490 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ctatgagtcacatttaattg

SEQ ID NO: 12491 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
gagtcacatttaattggaga

SEQ ID NO: 12492 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
ttggagaatgagtggaactt

SEQ ID NO: 12493 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
attatccaaccaacttttgg

SEQ ID NO: 12494 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tgtctcaaagtcttgctttc

SEQ ID NO: 12495 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aactgtgaacattttaaaga

SEQ ID NO: 12496 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
agactggatttgctgtggga

SEQ ID NO: 12497 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tggatttgctgtgggacaga

SEQ ID NO: 12498 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gaaatatataaaaagcaata

SEQ ID NO: 12499 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gaaaacaaatattacatacc

SEQ ID NO: 12500 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
aaccacaaaggagagcatct

SEQ ID NO: 12501 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ataaaaatattctgttgaag

SEQ ID NO: 12502 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
gacctcctttatgtttaggt

SEQ ID NO: 12503 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ggtgagggtggaggttgtgg

SEQ ID NO: 12504 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ggctacagtgtggtgagagg

SEQ ID NO: 12505 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGAT
atggcagaggtaggcagggg

SEQ ID NO: 12506 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGAAT
aggcaggggccggatcatgt

SEQ ID NO: 12507 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ggaatttgcatatcatagaa

SEQ ID NO: 12508 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tgcatatcatagaaatgagt

SEQ ID NO: 12509 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tcgtccttgtgcaaacatcc

SEQ ID NO: 12510 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gctcctgggctgcaaacctg

SEQ ID NO: 12511 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
tcagtaaggcagtaacataa

SEQ ID NO: 12512 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tctgattattgggagacttt

SEQ ID NO: 12513 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
gactatgaaatcagatattc

SEQ ID NO: 12514 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gaaatcagatattcttggat

SEQ ID NO: 12515 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ttctatcccttcttaagtaa

SEQ ID NO: 12516 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgcatctgtaaaatacgtat

SEQ ID NO: 12517 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
aagttgttaaatagtataaa

SEQ ID NO: 12518 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
tgtactagctgctcaaaaac

SEQ ID NO: 12519 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atttgagataaaactattga

SEQ ID NO: 12520 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aaacactcctgaacctcggg

SEQ ID NO: 12521 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ctcgggaaggatgggcctgg

SEQ ID NO: 12522 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ggaaggatgggcctggtaga

SEQ ID NO: 12523 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ctggtagagtgagtatggga

SEQ ID NO: 12524 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aacatccaaaatattttaat

SEQ ID NO: 12525 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tccaaaatattttaataagg

SEQ ID NO: 12526 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttaataaggatggattactt

SEQ ID NO: 12527 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
atttatcaaccactgaggag

SEQ ID NO: 12528 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ccactgaggagctgaattat

SEQ ID NO: 12529 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tactgtatttaacacagtat

SEQ ID NO: 12530 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tctttaaaaatgggaaaaaa

SEQ ID NO: 12531 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tgcttgtgcatattcaaaag

SEQ ID NO: 12532 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgggatgattctgaaagata

SEQ ID NO: 12533 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atgattctgaaagataaaga

SEQ ID NO: 12534 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tacttggcaggctgaggcag

SEQ ID NO: 12535 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ctgcattccagcctaggcga

SEQ ID NO: 12536 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
atttccacaaaaacttgtac

SEQ ID NO: 12537 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
acccaaatgtccatcaactg

SEQ ID NO: 12538 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gcatagatacatactatacc

SEQ ID NO: 12539 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ttccatgtatattaaatcta

SEQ ID NO: 12540 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
atgtatattaaatctacaga

SEQ ID NO: 12541 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
gctgggagaaaagggaaatg

SEQ ID NO: 12542 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ggaatgactactaacgggcc

SEQ ID NO: 12543 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
gtggcgatcgttgcacaact

SEQ ID NO: 12544 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ctctgagtatagtttaaaaa

SEQ ID NO: 12545 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gagttatacagtttaaaaaa

SEQ ID NO: 12546 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
caataaacctatttttaaaa

SEQ ID NO: 12547 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
gcagcataacggcaaaggtt

SEQ ID NO: 12548 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
taacggcaaaggttgtgggt

SEQ ID NO: 12549 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aaattgatataacaaaaata

SEQ ID NO: 12550 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
tattaaatctaatgaagatt

SEQ ID NO: 12551 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ggcttgggcctatggaagtg

SEQ ID NO: 12552 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
actctgagaaaactagtgca

SEQ ID NO: 12553 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tattagaaaaacaggaggaa

SEQ ID NO: 12554 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
tttcagcaggaggtgagaca

SEQ ID NO: 12555 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gtgggttaatttatttgatt

SEQ ID NO: 12556 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ccatgctggctaccaaatgg

SEQ ID NO: 12557 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ggagaaactctcacaaccaa

SEQ ID NO: 12558 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
cattctcatcaaatcatctg

SEQ ID NO: 12559 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ctttgaggaaataaaaacca

SEQ ID NO: 12560 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttgacttctccctctctctc

SEQ ID NO: 12561 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tttatagccaaatttcttgg

SEQ ID NO: 12562 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctctttctctgtgttctttt

SEQ ID NO: 12563 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttctgggtcctcttttctac

SEQ ID NO: 12564 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tctacctgaattctaaatgt

SEQ ID NO: 12565 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tctatctacttaaaaatatc

SEQ ID NO: 12566 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tttctttttgctgattgctc

SEQ ID NO: 12567 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
acgcaccaataaatgaaagt

SEQ ID NO: 12568 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ctacatttcagaagaaaata

SEQ ID NO: 12569 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
taatgtacagatttggaaga

SEQ ID NO: 12570 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ttcgctcttgttgcccaggc

SEQ ID NO: 12571 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAGT
ctcaccgcaacctctgcctc

SEQ ID NO: 12572 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
gattctcctgcctcagcctc

SEQ ID NO: 12573 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
gcctcagcctcctgagtagc

SEQ ID NO: 12574 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGGT
ttttgtatttttagtagaga

SEQ ID NO: 12575 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tgaagcaattccagaaagcg

SEQ ID NO: 12576 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aaaggctgtctgtgtacata

SEQ ID NO: 12577 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aaatactcctgctcatgttg

SEQ ID NO: 12578 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tctccgaacttctcttggtt

SEQ ID NO: 12579 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tcagaaataggagcaagact

SEQ ID NO: 12580 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
aacaatcagaaactggaaaa

SEQ ID NO: 12581 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
atttgattttatttatcaca

SEQ ID NO: 12582 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
attactttttattatctaag

SEQ ID NO: 12583 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
tcgtgacttccataccacac

SEQ ID NO: 12584 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
cagtgagagacaccatgcta

SEQ ID NO: 12585 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
agaaactctaattgatactt

SEQ ID NO: 12586 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tctgaattaagcagacttct

SEQ ID NO: 12587 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
aactcgtcattggttacaaa

SEQ ID NO: 12588 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tttgctttgtacaaatcttt

SEQ ID NO: 12589 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aactttaagatgttatagtt

SEQ ID NO: 12590 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ttttttatgatatagaaatt

SEQ ID NO: 12591 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
actgctagatagcttagaac

SEQ ID NO: 12592 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tgtagcagctttctatatat

SEQ ID NO: 12593 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
ctaaagtcttcttcactctc

SEQ ID NO: 12594 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
taatgtttcattattttcaa

SEQ ID NO: 12595 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
acactcagacagaacacagt

SEQ ID NO: 12596 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tcagaaagcttcttcactga

SEQ ID NO: 12597 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tttgtaatgacataaagcct

SEQ ID NO: 12598 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
cctaattcaaaaaaagcctt

SEQ ID NO: 12599 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaaataggaacatattctca

SEQ ID NO: 12600 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gtattttaaaatcaattaaa

SEQ ID NO: 12601 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tgtttaaccccactctcacc

SEQ ID NO: 12602 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttttcaatgctcggagaact

SEQ ID NO: 12603 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
ctgtcacatatctgtaatag

SEQ ID NO: 12604 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
aagaacaactcccaaatagt

SEQ ID NO: 12605 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
actcccaaatagttggagtt

SEQ ID NO: 12606 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
cacaccaattacttcttacc

SEQ ID NO: 12607 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
caaattctgttaaatacctg

SEQ ID NO: 12608 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aaatacctgtagaattaaat

SEQ ID NO: 12609 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
agaattaaatcagaattatt

SEQ ID NO: 12610 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
agaattattcagaatttaga

SEQ ID NO: 12611 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
agatattatatattattaaa

SEQ ID NO: 12612 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tccatagagataaaacatag

SEQ ID NO: 12613 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ggaaattgaagtgactgcta

SEQ ID NO: 12614 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gaagtgactgctaatgagta

SEQ ID NO: 12615 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
atgagtacagagtttctatt

SEQ ID NO: 12616 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgtcaatatactgaaaaaca

SEQ ID NO: 12617 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gaattgtatactttaaaatt

SEQ ID NO: 12618 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aattgtgaattttgtagtat

SEQ ID NO: 12619 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tgatggaaaagaggttaggc

SEQ ID NO: 12620 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aagaggttaggcagggatga

SEQ ID NO: 12621 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGGAT
gttaggcagggatgaaggaa

SEQ ID NO: 12622 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ggatgaaggaatcggatatt

SEQ ID NO: 12623 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tctaggtggctccagtgaac

SEQ ID NO: 12624 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tcaaagtcattaacggaaaa

SEQ ID NO: 12625 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ctgataaatacatttgggaa

SEQ ID NO: 12626 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttgggaaaagagtaacaatt

SEQ ID NO: 12627 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
atattttccttgaaaataaa

SEQ ID NO: 12628 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aatacaaaaatataaaataa

SEQ ID NO: 12629 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
tataaaataattgaataata

SEQ ID NO: 12630 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
ctgtacttgtatttaaaggc

SEQ ID NO: 12631 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
ctcaatgatgtcacatacct

SEQ ID NO: 12632 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGGT
gacaaaatccagccagttcc

SEQ ID NO: 12633 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tccacgggtcacgaagaaaa

SEQ ID NO: 12634 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
cctacacagaagcctcttgc

SEQ ID NO: 12635 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
acctaaacacaagattccat

SEQ ID NO: 12636 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
attgggatactagatgtgaa

SEQ ID NO: 12637 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ccactggaagacatatattg

SEQ ID NO: 12638 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
catatattggaggatggctg

SEQ ID NO: 12639 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cagaggtacttgaaataact

SEQ ID NO: 12640 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
taattataaaacatacaccc

SEQ ID NO: 12641 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
atgtgtaacatgtctaagaa

SEQ ID NO: 12642 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
acttcctggcaggaaaagga

SEQ ID NO: 12643 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
gacatttttggtccagtccg

SEQ ID NO: 12644 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gtcataaatatgcagtttgt

SEQ ID NO: 12645 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tagtgcacatgatgagcatg

SEQ ID NO: 12646 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gcatgctgaataaggtagct

SEQ ID NO: 12647 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
ggaacaaaagagacgacagt

SEQ ID NO: 12648 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
agtgggaatttgaaatattt

SEQ ID NO: 12649 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tattttgtctctttgaacaa

SEQ ID NO: 12650 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tgaaattaataaactaaaac

SEQ ID NO: 12651 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aaaaggtataacatctatat

SEQ ID NO: 12652 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aattacaccataaagtgcca

SEQ ID NO: 12653 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ctggatgtaatcatttttaa

SEQ ID NO: 12654 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
gtaatcatttttaaaaggat

SEQ ID NO: 12655 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
agtctgcaggaggaaaaaga

SEQ ID NO: 12656 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gaaaaagaaaggatgaaatt

SEQ ID NO: 12657 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tatttttatcataaaacctt

SEQ ID NO: 12658 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
agcagcacatgttccaaaat

SEQ ID NO: 12659 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ttcctaagttgaaggaacgt

SEQ ID NO: 12660 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tgaaggaacgtcagagttgg

SEQ ID NO: 12661 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tggaagaatccttccaatca

SEQ ID NO: 12662 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ttaaaagggacttaaattaa

SEQ ID NO: 12663 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
acggtaatttaaaaaacgat

SEQ ID NO: 12664 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
ctgactttctaaattttata

SEQ ID NO: 12665 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
aattttatatagggttatca

SEQ ID NO: 12666 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
cgtattcaggaggtaagtct

SEQ ID NO: 12667 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
gttccctcaagaaaacaaat

SEQ ID NO: 12668 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gtccccgcccaaatctcatt

SEQ ID NO: 12669 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
agggacctggtggtaagtga

SEQ ID NO: 12670 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ccagtgctgttctcatgata

SEQ ID NO: 12671 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
tgctgttctcatgatagtga

SEQ ID NO: 12672 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
gttctcatgatagtgagtga

SEQ ID NO: 12673 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
gtgagttctcatgagatctg

SEQ ID NO: 12674 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ctcccctgccattcagaaca

SEQ ID NO: 12675 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
agaccatcctggctaacacg

SEQ ID NO: 12676 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGGT
aaaattagccaggtgtggtg

SEQ ID NO: 12677 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
taccctggaggctgaggtgg

SEQ ID NO: 12678 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
tatcataacaggtaatgaaa

SEQ ID NO: 12679 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
agtttgaacaaaaataaggc

SEQ ID NO: 12680 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
acagaaaaatataaaggggg

SEQ ID NO: 12681 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aaatataaagggggaagaat

SEQ ID NO: 12682 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
gaatgagagtgaagagggaa

SEQ ID NO: 12683 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atacttgaaattttaataaa

SEQ ID NO: 12684 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
taaaaacttttaagtgattt

SEQ ID NO: 12685 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
ttttgggtctgcatacacat

SEQ ID NO: 12686 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aatttcacaattgcttcaaa

SEQ ID NO: 12687 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tcaaagagaataaaatacct

SEQ ID NO: 12688 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
acctaggaatccaacttaca

SEQ ID NO: 12689 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
cactgctcaaggaaataaaa

SEQ ID NO: 12690 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
attccatgctcatgtgtagg

SEQ ID NO: 12691 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
agaaaaacaagcaatgggga

SEQ ID NO: 12692 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ccatatgtagaaagctgaaa

SEQ ID NO: 12693 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tatacaaaaatcaattcaag

SEQ ID NO: 12694 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
caaaagacaaaattgacaaa

SEQ ID NO: 12695 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
acagcaaaataaactaccat

SEQ ID NO: 12696 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tctgacaaaaggctaatatc

SEQ ID NO: 12697 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agataccatctcacaccagt

SEQ ID NO: 12698 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aggaaacaacaggtgctgga

SEQ ID NO: 12699 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
agtcagtgtggcgattcctc

SEQ ID NO: 12700 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ttgacccagccatcccatta

SEQ ID NO: 12701 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aaatgtccaacaatgataga

SEQ ID NO: 12702 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aatgtggctcatatacacca

SEQ ID NO: 12703 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ctatgcagccataaaaaatg

SEQ ID NO: 12704 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ttcacgtcctttgtagggac

SEQ ID NO: 12705 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cattctcagtaaactatcac

SEQ ID NO: 12706 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
gcatattctcactcataggt

SEQ ID NO: 12707 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
aatcacatggacacaggaag

SEQ ID NO: 12708 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tcacactctagggactgtgg

SEQ ID NO: 12709 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
gtggggtggggggagggggg

SEQ ID NO: 12710 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
taatgctagatgaccagtta

SEQ ID NO: 12711 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aatttgaaaaagtacagatt

SEQ ID NO: 12712 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
cacctttttgtctgcatagt

SEQ ID NO: 12713 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ggctctgacaccatgccggg

SEQ ID NO: 12714 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
catcatctttcttttcttct

SEQ ID NO: 12715 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
cagctcctcacataagaggc

SEQ ID NO: 12716 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ctacaaaaggtaacatgttc

SEQ ID NO: 12717 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ctagaattatcagcttgtta

SEQ ID NO: 12718 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aagtaaaaaatgacaatttt

SEQ ID NO: 12719 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aacctctcatagtcatccat

SEQ ID NO: 12720 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tcatagtcatccatgagagt

SEQ ID NO: 12721 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
attaatgttctaataacatc

SEQ ID NO: 12722 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ttctaataacatctagaatg

SEQ ID NO: 12723 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
acttttcccagacccatcag

SEQ ID NO: 12724 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
actctttggcccataggcta

SEQ ID NO: 12725 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tttggcccataggctacaga

SEQ ID NO: 12726 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
gtacctctccgttagagctc

SEQ ID NO: 12727 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ttctatttatagagcacagg

SEQ ID NO: 12728 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tataattcttaagagatttt

SEQ ID NO: 12729 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tataattattatttaatttt

SEQ ID NO: 12730 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tatagttattatttaatttt

SEQ ID NO: 12731 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atttaattttctgaatagta

SEQ ID NO: 12732 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gaatataattatttaatttt

SEQ ID NO: 12733 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tataattattatgtaatttt

SEQ ID NO: 12734 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tataattattatgtaatttt

SEQ ID NO: 12735 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
agtaaataattattaatatt

SEQ ID NO: 12736 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
gctgcattatcccctaacaa

SEQ ID NO: 12737 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aatgatcttagctagatctt

SEQ ID NO: 12738 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
acttctttccttcaatctca

SEQ ID NO: 12739 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
cctctcagccttcatacaat

SEQ ID NO: 12740 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
attggagttatggccttgct

SEQ ID NO: 12741 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
cttatcattcatgtgttcac

SEQ ID NO: 12742 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tagcacatttgatttccttc

SEQ ID NO: 12743 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
tcttcctttacttgaacatt

SEQ ID NO: 12744 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
tttacttgaacattaggggt

SEQ ID NO: 12745 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
cttgaacattaggggtggga

SEQ ID NO: 12746 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ctgaggaaagggagagagat

SEQ ID NO: 12747 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
atgattgtttgctgtcttat

SEQ ID NO: 12748 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttacaaagttgaaatattgt

SEQ ID NO: 12749 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
gctgacagacttgcttaatg

SEQ ID NO: 12750 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ccacaaaccttcaacttgta

SEQ ID NO: 12751 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
attttgatggaaaccaaagt

SEQ ID NO: 12752 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agttaggataaaggttttta

SEQ ID NO: 12753 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aaagaatgtagtgaaaaata

SEQ ID NO: 12754 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
ttcatatacacattcaaaag

SEQ ID NO: 12755 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
taggatgattctgaaaggta

SEQ ID NO: 12756 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
actacttggtacagactcaa

SEQ ID NO: 12757 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gtccacacaagaacgtttac

SEQ ID NO: 12758 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
cacaacctcattactcacca

SEQ ID NO: 12759 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
cattactcaccaatgaataa

SEQ ID NO: 12760 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
accaatgaataaatggataa

SEQ ID NO: 12761 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
aataaatggataaaggaatg

SEQ ID NO: 12762 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gaatgtgggatattcaaaca

SEQ ID NO: 12763 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gtataggtacatgttacaac

SEQ ID NO: 12764 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
attccatcttatgaaatgtc

SEQ ID NO: 12765 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
aaatccccagaaacaaaatg

SEQ ID NO: 12766 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
agagtattttttgtcagagg

SEQ ID NO: 12767 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ggttatgtggttaatggtta

SEQ ID NO: 12768 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
aaagagtatggggcttcttt

SEQ ID NO: 12769 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tgtgaacatactaaaaacca

SEQ ID NO: 12770 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tatatcttaataaaactact

SEQ ID NO: 12771 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aactactatgaatatgcatt

SEQ ID NO: 12772 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atgaatatgcattaagaatt

SEQ ID NO: 12773 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aaatatgtgaaaattgtcct

SEQ ID NO: 12774 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
agtaaaaaggaaacaaatca

SEQ ID NO: 12775 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGAT
aaatcataaaggtgagaaga

SEQ ID NO: 12776 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gctcttgaagaaaagttggc

SEQ ID NO: 12777 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
gtagattctacattcaactg

SEQ ID NO: 12778 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tggagggtaccatctctttc

SEQ ID NO: 12779 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gcacatgctcaacacagctc

SEQ ID NO: 12780 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
atatgaaaaaagcagaggca

SEQ ID NO: 12781 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
agagcagctttagttggcat

SEQ ID NO: 12782 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
aagttattgtaccaggccag

SEQ ID NO: 12783 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
gtggcaagatgataggctga

SEQ ID NO: 12784 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tttcctcttcccttagtctt

SEQ ID NO: 12785 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cttctggataaacaggccac

SEQ ID NO: 12786 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ttaagatttgagatttctgg

SEQ ID NO: 12787 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
acattctaataaaagtgaaa

SEQ ID NO: 12788 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aatgaatacttatttaatgt

SEQ ID NO: 12789 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aggcaaaatcgaaaaagata

SEQ ID NO: 12790 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gatgaagtgcttttccttta

SEQ ID NO: 12791 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
gggaaatcagtgttgcctgt

SEQ ID NO: 12792 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
taataaataatgtgtactgt

SEQ ID NO: 12793 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ctgctcgggaggctgaggca

SEQ ID NO: 12794 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
ataaagtgtacaaacttttt

SEQ ID NO: 12795 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ctatcaaaagccttaaacac

SEQ ID NO: 12796 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgccaaataattttccttct

SEQ ID NO: 12797 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
caatccaaaatcctaacagt

SEQ ID NO: 12798 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gggttacactaaatgaagta

SEQ ID NO: 12799 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gagcgttcaaagactattta

SEQ ID NO: 12800 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aagactatttaatgaattaa

SEQ ID NO: 12801 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aaaatataatgcataataag

SEQ ID NO: 12802 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ttagccctagttaagagatt

SEQ ID NO: 12803 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tactatgattgtatcttctt

SEQ ID NO: 12804 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tcaccattaatctcatatta

SEQ ID NO: 12805 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gcaactactaaaattaaaaa

SEQ ID NO: 12806 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ttatctatgcttatccatct

SEQ ID NO: 12807 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
acagtctagaacactcatct

SEQ ID NO: 12808 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gaacactcatctgagaatgt

SEQ ID NO: 12809 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gaaaacaagttgattaatcc

SEQ ID NO: 12810 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tctctatgttaaatatgtag

SEQ ID NO: 12811 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tatctccaagctatcaccaa

SEQ ID NO: 12812 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
attaattaaggtaggactcc

SEQ ID NO: 12813 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
atgtccattttagctagaac

SEQ ID NO: 12814 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
cattttagctagaaccaggg

SEQ ID NO: 12815 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
gtcatccctctctttcaaga

SEQ ID NO: 12816 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ataaatattaatagattatc

SEQ ID NO: 12817 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
aaaaaaaaaagcaaacattg

SEQ ID NO: 12818 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
cctagagaaatttgaggaga

SEQ ID NO: 12819 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
caaaaacaacaacatcaatt

SEQ ID NO: 12820 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tgtgaaacaaaaaatttcag

SEQ ID NO: 12821 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
acccaaaaggggcactttac

SEQ ID NO: 12822 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tatgtatatgtaaaaatgca

SEQ ID NO: 12823 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gatttttctatatattttag

SEQ ID NO: 12824 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aaaataaaacttagaagata

SEQ ID NO: 12825 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gtaatggcagaaaattcacc

SEQ ID NO: 12826 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaataagataactaactaaa

SEQ ID NO: 12827 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gtgtgatgagagaaaatatt

SEQ ID NO: 12828 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tcttttttttttaagttact

SEQ ID NO: 12829 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaaagtacttctaaaacaca

SEQ ID NO: 12830 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
caagatgtttcacaaatagt

SEQ ID NO: 12831 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
atagtgtgaataaaagcaaa

SEQ ID NO: 12832 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aatagccatattgtccaaat

SEQ ID NO: 12833 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gcatgaacttgaacaactgg

SEQ ID NO: 12834 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
actggtagaattgaagcaga

SEQ ID NO: 12835 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ttgaagcagagaggatccac

SEQ ID NO: 12836 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ttgatgtgttcttcaagtag

SEQ ID NO: 12837 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tgttcttcaagtagcagagt

SEQ ID NO: 12838 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tattatcagtgtaaaagtaa

SEQ ID NO: 12839 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
acaaaaattgagaggtagag

SEQ ID NO: 12840 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaaggtataaatccaaccca

SEQ ID NO: 12841 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
gaaatgaaaacataactgct

SEQ ID NO: 12842 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aacataactgcttggaattt

SEQ ID NO: 12843 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tccctagataatggctttaa

SEQ ID NO: 12844 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
agggataaagcaaaaattgt

SEQ ID NO: 12845 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
cttctactttctctgcttag

SEQ ID NO: 12846 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
gatgaatactgaacacttca

SEQ ID NO: 12847 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgctaccaatggctggcttg

SEQ ID NO: 12848 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
catttgtctctatggttgtc

SEQ ID NO: 12849 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gttgtcaagagtgtatatat

SEQ ID NO: 12850 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
actccactgtggctattgac

SEQ ID NO: 12851 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tgttaaatcaaaaatatcag

SEQ ID NO: 12852 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ttcaaaaagtagaaaagttt

SEQ ID NO: 12853 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttttgtttggtttgaagaca

SEQ ID NO: 12854 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ttaactattttaaaattgga

SEQ ID NO: 12855 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGGT
caacattttcggaggccaag

SEQ ID NO: 12856 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
attttcggaggccaaggcgg

SEQ ID NO: 12857 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cgggtgaatcacttgagggc

SEQ ID NO: 12858 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
acctgtagtctcagctgctt

SEQ ID NO: 12859 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
cttgagagtagctaaggtgg

SEQ ID NO: 12860 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
atcacctgagcctggggagg

SEQ ID NO: 12861 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tcacaccactgcggtccagc

SEQ ID NO: 12862 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAGT
aacaacacatattttgaact

SEQ ID NO: 12863 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttatgttcaattaaagaaag

SEQ ID NO: 12864 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tcaattaaagaaagaagagt

SEQ ID NO: 12865 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
agttggaatgaggggaaaaa

SEQ ID NO: 12866 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
aaggaagatgataaaccaaa

SEQ ID NO: 12867 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aggcatgcagtgctcctcct

SEQ ID NO: 12868 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
cttgatgctgtaaaataatc

SEQ ID NO: 12869 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
acgctgatcttccaactttc

SEQ ID NO: 12870 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
taaaaaaaatttcattttat

SEQ ID NO: 12871 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tccatttgatccaatgtaaa

SEQ ID NO: 12872 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
aagattcctagtttgaaaaa

SEQ ID NO: 12873 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gagttaataatcatgctccg

SEQ ID NO: 12874 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tatataaagtgcttaacagg

SEQ ID NO: 12875 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ttctattttaattccttgct

SEQ ID NO: 12876 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
atatattaattatattaaat

SEQ ID NO: 12877 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
atgaggatatttccatttat

SEQ ID NO: 12878 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tattaaacagagatttagtt

SEQ ID NO: 12879 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
cagagatttagtttagagta

SEQ ID NO: 12880 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
aagttcaggagctagaaagc

SEQ ID NO: 12881 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ggagctagaaagcctgggtt

SEQ ID NO: 12882 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
gaaagcctgggttttgaata

SEQ ID NO: 12883 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aatgtaattttaaacaatac

SEQ ID NO: 12884 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaacaatacaagagtatccc

SEQ ID NO: 12885 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
gaatgactgttgattgctca

SEQ ID NO: 12886 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
actgttgattgctcaaagga

SEQ ID NO: 12887 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ctcaaaggattgggtcactg

SEQ ID NO: 12888 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
acttttttcttttttattca

SEQ ID NO: 12889 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
attcattgaatattgctgaa

SEQ ID NO: 12890 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tcattaatgtaatctctgaa

SEQ ID NO: 12891 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gtaatctctgaacagaatac

SEQ ID NO: 12892 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aagaaatattacagtctctc

SEQ ID NO: 12893 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
cttcacatagggaaaatcta

SEQ ID NO: 12894 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
tctataggatgaggtgggaa

SEQ ID NO: 12895 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
aataactaaaaggaaaaaat

SEQ ID NO: 12896 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
caattctattgtggctcagt

SEQ ID NO: 12897 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tgaaagctatatttatttaa

SEQ ID NO: 12898 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tactcaggaggctgaggcag

SEQ ID NO: 12899 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tttggaagatctgccaaaat

SEQ ID NO: 12900 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ctgccaaaatctgaatgaga

SEQ ID NO: 12901 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaagcattctcaaggcacca

SEQ ID NO: 12902 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
taccattgatactatgtgat

SEQ ID NO: 12903 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
gttaaatgtaatgtggtagc

SEQ ID NO: 12904 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tagtgaaaaactaaggaact

SEQ ID NO: 12905 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
aaaaactaaggaactctgaa

SEQ ID NO: 12906 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
actgttaataacaggggaaa

SEQ ID NO: 12907 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
ataacaggggaaactggatg

SEQ ID NO: 12908 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gcaaaaggaaatcacagatg

SEQ ID NO: 12909 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
ataaaggtaataatagctca

SEQ ID NO: 12910 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gtaataatagctcagtgaat

SEQ ID NO: 12911 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttgaaccacttttaattaaa

SEQ ID NO: 12912 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
cttaaagtaatcatgcctgg

SEQ ID NO: 12913 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ttttctataaatgcactctc

SEQ ID NO: 12914 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
taaatgcactctcctgggtc

SEQ ID NO: 12915 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ttataaacatagaactaaac

SEQ ID NO: 12916 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
ctaaactggagtcacaatgt

SEQ ID NO: 12917 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tctgagtcctaattatactt

SEQ ID NO: 12918 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
ctaaaaaaatacacttatga

SEQ ID NO: 12919 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatctgtgtgtattttcttt

SEQ ID NO: 12920 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
acagctccactctggctgac

SEQ ID NO: 12921 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gaaaacagaaaaatttccag

SEQ ID NO: 12922 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tcttggcaccaagaaaatat

SEQ ID NO: 12923 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttcctacacctggcctccga

SEQ ID NO: 12924 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
taagaagtacaatttagtca

SEQ ID NO: 12925 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aagtcaaaggtgcgaaacga

SEQ ID NO: 12926 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gtgcgaaacgattgaatctg

SEQ ID NO: 12927 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tatccattcctatgtgctcc

SEQ ID NO: 12928 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ctatgtgctccttgaattat

SEQ ID NO: 12929 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
gacagctctaccctagctgt

SEQ ID NO: 12930 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aaatttgattcaatccttgg

SEQ ID NO: 12931 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
acagcatttatgttccaagc

SEQ ID NO: 12932 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ccaagccaggattttgtgtc

SEQ ID NO: 12933 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
acagaaaataccaagacagc

SEQ ID NO: 12934 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
tttgcttaaataacatccta

SEQ ID NO: 12935 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ggctgaagactgggaccact

SEQ ID NO: 12936 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aacttttcattttctgtctt

SEQ ID NO: 12937 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ctgtaatatgggcagaaagt

SEQ ID NO: 12938 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tccttggcctcccaaagtgc

SEQ ID NO: 12939 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ggttgtaatttattatattt

SEQ ID NO: 12940 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
accaaatctatacacttaag

SEQ ID NO: 12941 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
cttaagtagagtaaaaacac

SEQ ID NO: 12942 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ctggaattgagccagccatt

SEQ ID NO: 12943 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
attgactgcccatcttcact

SEQ ID NO: 12944 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
actaaaagactagcatgagc

SEQ ID NO: 12945 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tcacaatttaactattgtcc

SEQ ID NO: 12946 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agcttcatttaactaattag

SEQ ID NO: 12947 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttatgtacctgggaactttt

SEQ ID NO: 12948 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tgacactctggaacattaga

SEQ ID NO: 12949 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
agagagtgaaaatattattc

SEQ ID NO: 12950 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aaaatattattctagagtga

SEQ ID NO: 12951 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
catggtttgtttcgtttgtg

SEQ ID NO: 12952 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
aattcatcaaactatatttt

SEQ ID NO: 12953 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
ttaacttttattttaagttc

SEQ ID NO: 12954 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
cataggtaaacttgtgtcat

SEQ ID NO: 12955 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tttctgaaaactcaagttga

SEQ ID NO: 12956 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aggaaaagatcttagacaaa

SEQ ID NO: 12957 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tggaaacacagcaagaaatg

SEQ ID NO: 12958 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
cagcaagaaatgaagaatat

SEQ ID NO: 12959 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
taagtccaatttttattttc

SEQ ID NO: 12960 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
attattttagtctacaacat

SEQ ID NO: 12961 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ttgtgtagaaaacaccatcc

SEQ ID NO: 12962 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
taacttgctagcacaattaa

SEQ ID NO: 12963 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
aggtatacaacatgatgcta

SEQ ID NO: 12964 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
gttgtttgttattgttgggg

SEQ ID NO: 12965 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
attttggtcagggaaggaag

SEQ ID NO: 12966 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tctttggctttgtccttcga

SEQ ID NO: 12967 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tattctaattaaaaatttta

SEQ ID NO: 12968 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
aatcataacttacttgtatt

SEQ ID NO: 12969 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tctttctgttttcttgaaaa

SEQ ID NO: 12970 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gaaaattgaatattgtacac

SEQ ID NO: 12971 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tcagatgatcaggcattagt

SEQ ID NO: 12972 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
gcattagttagagtctcata

SEQ ID NO: 12973 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aataaagcttgcacttctct

SEQ ID NO: 12974 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
cagtatctgtcactggccca

SEQ ID NO: 12975 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tataaacagatccaggtttt

SEQ ID NO: 12976 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
aaagacagattaatataaaa

SEQ ID NO: 12977 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tagtctttcttttaccacaa

SEQ ID NO: 12978 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tgatagttgagcaaatttct

SEQ ID NO: 12979 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ccatcaagtttctttcacat

SEQ ID NO: 12980 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
cctcaatgtagtgatgtatg

SEQ ID NO: 12981 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
gattcactcttctttataaa

SEQ ID NO: 12982 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
actggattattacacaatcc

SEQ ID NO: 12983 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
atttaatagtgctataagag

SEQ ID NO: 12984 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ataaaaagtcaaaaatgaca

SEQ ID NO: 12985 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
atccaatcttccttcttatc

SEQ ID NO: 12986 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
cccattgtgtgtagtggtga

SEQ ID NO: 12987 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
catctcctaagcttattcaa

SEQ ID NO: 12988 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tgccctttactttgaacttg

SEQ ID NO: 12989 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
tttattgaaattcccttgtg

SEQ ID NO: 12990 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gggtctatgtacagctatag

SEQ ID NO: 12991 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
gtgaccagtagtctagccag

SEQ ID NO: 12992 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tagtttcccaaagccttcca

SEQ ID NO: 12993 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
caaagccttccaatgaatgc

SEQ ID NO: 12994 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aagtgattaaagcatttctt

SEQ ID NO: 12995 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cataatgcagtctgtaaatg

SEQ ID NO: 12996 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
caagaaaatatggcaaatcc

SEQ ID NO: 12997 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agttattaaataataattgt

SEQ ID NO: 12998 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tctaaaccagtggtcctcaa

SEQ ID NO: 12999 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
aattcttccctacctccagg

SEQ ID NO: 13000 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ctacctccaggtggagttac

SEQ ID NO: 13001 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gagttaccagagttagcaaa

SEQ ID NO: 13002 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gaatacacagtcagttaaat

SEQ ID NO: 13003 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
attaacagctccttgttttg

SEQ ID NO: 13004 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
acttgtttttttttattttt

SEQ ID NO: 13005 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tgacaaaacagaacattgtc

SEQ ID NO: 13006 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
atgaatttttattcccttct

SEQ ID NO: 13007 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
taatttctcctgttccatta

SEQ ID NO: 13008 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ttaaaggatcaaattcttca

SEQ ID NO: 13009 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
taaaacagccttggcataca

SEQ ID NO: 13010 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
aatcctattgctaaaagata

SEQ ID NO: 13011 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aaataagtagtctttactca

SEQ ID NO: 13012 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gggttattttaaaagtcagc

SEQ ID NO: 13013 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aatttgtgagaccttttctt

SEQ ID NO: 13014 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttcggtgctttaaataaact

SEQ ID NO: 13015 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gcatctattaaagagagcca

SEQ ID NO: 13016 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
atgtgaaagaactgaaaata

SEQ ID NO: 13017 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ttacaaaaattcttcattag

SEQ ID NO: 13018 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cttcattagtagagtctgaa

SEQ ID NO: 13019 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gaacagaataaatgctgaaa

SEQ ID NO: 13020 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gctgtttgagcagcgtcatg

SEQ ID NO: 13021 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
tatgactactaactcaatca

SEQ ID NO: 13022 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAGT
ttttatgagaaaattattat

SEQ ID NO: 13023 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gaaaattattatacgagtaa

SEQ ID NO: 13024 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gtaatctctgtaacagtaaa

SEQ ID NO: 13025 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aattattttatcttcttcat

SEQ ID NO: 13026 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
gctgcacaaagagcttcaaa

SEQ ID NO: 13027 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ttacttgcattttgacattt

SEQ ID NO: 13028 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tacttctacacaaataaaaa

SEQ ID NO: 13029 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tggatattagtaattgaccc

SEQ ID NO: 13030 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tgacccaggaattgaaaaga

SEQ ID NO: 13031 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
actcataactaaacataaac

SEQ ID NO: 13032 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aacaagagttgagccaatga

SEQ ID NO: 13033 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
acagtaaattgaactaaata

SEQ ID NO: 13034 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ataaggtttggggaaatgtg

SEQ ID NO: 13035 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
agctgtgttagtgtggacac

SEQ ID NO: 13036 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
aattttggaaacatggtcac

SEQ ID NO: 13037 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
accataggggcaggcactga

SEQ ID NO: 13038 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
acagggtgatgttcgggact

SEQ ID NO: 13039 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
actttcagaagcatagttac

SEQ ID NO: 13040 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
attttcagaaacatggccac

SEQ ID NO: 13041 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
agaaacatggccactggaat

SEQ ID NO: 13042 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tcagagcctgtgtactgatt

SEQ ID NO: 13043 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aagaccattcttttcctttc

SEQ ID NO: 13044 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
aagcacagtctgagcatgta

SEQ ID NO: 13045 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tttcttgtcattatttccta

SEQ ID NO: 13046 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tcattatttcctaatgaatg

SEQ ID NO: 13047 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
gcagaataacaacaattaca

SEQ ID NO: 13048 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
agatgatttaaagtatacgg

SEQ ID NO: 13049 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
tttaaagtatacggtaggat

SEQ ID NO: 13050 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ttagccaaacctgctagaaa

SEQ ID NO: 13051 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aaacctgctagaaagaggat

SEQ ID NO: 13052 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ctgtcttgacaaagccaata

SEQ ID NO: 13053 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
tcatgggaacatggaggaag

SEQ ID NO: 13054 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
gtgcttgctatggacacctg

SEQ ID NO: 13055 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gaggctgctaaagttcctat

SEQ ID NO: 13056 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
ctttttccatttaacaatgc

SEQ ID NO: 13057 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
taaacggcctgagaggctgg

SEQ ID NO: 13058 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
cttttatagtacacttaata

SEQ ID NO: 13059 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
cttaataaaggatacctgtg

SEQ ID NO: 13060 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
acaaagaaagtggagagaaa

SEQ ID NO: 13061 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
ctcacttttcacatagtcta

SEQ ID NO: 13062 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gcagaaagatcggttaccaa

SEQ ID NO: 13063 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
ataaaactgatatgattggt

SEQ ID NO: 13064 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGAT
ctggaaatggcagttgaact

SEQ ID NO: 13065 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ttcttatgagaggaaactag

SEQ ID NO: 13066 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctggaacttaaaatgggagg

SEQ ID NO: 13067 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tttggagacaccagcatata

SEQ ID NO: 13068 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
agagtattttgacattgccc

SEQ ID NO: 13069 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
acaaaacatggcaaaacagc

SEQ ID NO: 13070 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
aaaagtaccttggaaacaca

SEQ ID NO: 13071 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ggtataggaaagaaggaaag

SEQ ID NO: 13072 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ggaaagaaggaaagttgagt

SEQ ID NO: 13073 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gttgagttggaattcagcag

SEQ ID NO: 13074 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tcagtttactcatcggtaaa

SEQ ID NO: 13075 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
atcggtaaaatgagtatgaa

SEQ ID NO: 13076 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aaatgagtatgaaaaggatt

SEQ ID NO: 13077 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaaggattttgaatatttaa

SEQ ID NO: 13078 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gttaatgcatataaacactc

SEQ ID NO: 13079 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
tattatcattattaggcagg

SEQ ID NO: 13080 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
ctacttggcagcactcttcc

SEQ ID NO: 13081 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
aaaccagagctttcaaacgg

SEQ ID NO: 13082 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
gccaggcattctccttgtat

SEQ ID NO: 13083 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
ggtccacattgagcagttgt

SEQ ID NO: 13084 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
aaagggacatgcccacttac

SEQ ID NO: 13085 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
tacaggagtcactgcattaa

SEQ ID NO: 13086 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
caccagtatgatattactat

SEQ ID NO: 13087 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ttcgtgacctgacaattggg

SEQ ID NO: 13088 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatacaaatcagttattttg

SEQ ID NO: 13089 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tttgtagaatgcgtctcaac

SEQ ID NO: 13090 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgcgtctcaacttgggttca

SEQ ID NO: 13091 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ggaaactaaagcgttatcta

SEQ ID NO: 13092 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
acagctgtgtgtagcagagc

SEQ ID NO: 13093 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aaaaaagataacattagagg

SEQ ID NO: 13094 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
aaatgcagaaatacatggct

SEQ ID NO: 13095 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgttgcaaaggtcttggcat

SEQ ID NO: 13096 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tttggctttattcagcagac

SEQ ID NO: 13097 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
tgagtttagaaattcaatca

SEQ ID NO: 13098 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
tatcaacagcaacataattt

SEQ ID NO: 13099 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gggaaagacatgcatgttct

SEQ ID NO: 13100 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gcatgttcttagaattttgt

SEQ ID NO: 13101 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
tagaattttgttagaatgta

SEQ ID NO: 13102 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gactccctctgttaactata

SEQ ID NO: 13103 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
actataatgaatttaggaag

SEQ ID NO: 13104 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
atatttaaattaacaaaaac

SEQ ID NO: 13105 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aaatgtagcacttcaaggag

SEQ ID NO: 13106 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatagatgagaaccttagtg

SEQ ID NO: 13107 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
gagaaccttagtgtagaata

SEQ ID NO: 13108 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tttaccactcttgtatgaac

SEQ ID NO: 13109 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGGT
ttcactggtgaggaagttac

SEQ ID NO: 13110 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
cgggtagtctgttagaaaga

SEQ ID NO: 13111 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
aggcaggacaagcacctggc

SEQ ID NO: 13112 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaccagtctccttaatgaaa

SEQ ID NO: 13113 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ctcaaataacacatcttggg

SEQ ID NO: 13114 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
atttatatcgactatttgac

SEQ ID NO: 13115 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ctactactgattcttggttt

SEQ ID NO: 13116 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
ctcactgcagcctccacctc

SEQ ID NO: 13117 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
ttgtctattttttatagaaa

SEQ ID NO: 13118 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
acctcagcctcccaaagtgc

SEQ ID NO: 13119 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttcatgtacaaatatatgcc

SEQ ID NO: 13120 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tttaactatcatgtatgtaa

SEQ ID NO: 13121 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
caaatggaaatttcacattc

SEQ ID NO: 13122 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
catatctatataatgacatg

SEQ ID NO: 13123 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
cagaagtcaggctttgagct

SEQ ID NO: 13124 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aatttgatagaagacaatga

SEQ ID NO: 13125 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
caatatgcctaaatatgtac

SEQ ID NO: 13126 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ctccacaaagagacactgct

SEQ ID NO: 13127 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
aaacaaactacagctgctct

SEQ ID NO: 13128 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
agaagaaaggaaaaaggaag

SEQ ID NO: 13129 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaggtttcggttttaacctt

SEQ ID NO: 13130 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
ggttttaaccttaagaatac

SEQ ID NO: 13131 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ttgttttgtaagcatacttg

SEQ ID NO: 13132 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
gaataatgtcaatacatagg

SEQ ID NO: 13133 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gcatttactttaaaatcgtt

SEQ ID NO: 13134 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
taatagaaccaatctagtca

SEQ ID NO: 13135 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
ttttttaaagattaaaccat

SEQ ID NO: 13136 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaaattttctacctcacgtt

SEQ ID NO: 13137 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tttctacctcacgtttagaa

SEQ ID NO: 13138 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aataaaagatctcccaataa

SEQ ID NO: 13139 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aatctatcattaccttgatc

SEQ ID NO: 13140 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aaattgaaacttttaaagat

SEQ ID NO: 13141 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gcaaaaacgtttttagcaca

SEQ ID NO: 13142 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tttttagcacatagagtgca

SEQ ID NO: 13143 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tagatttgtgataacctatt

SEQ ID NO: 13144 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgttgatattttatagaact

SEQ ID NO: 13145 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
taaaatatttattttatttc

SEQ ID NO: 13146 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
aacctttggtttgaggacta

SEQ ID NO: 13147 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
actatgagaaagaacctgat

SEQ ID NO: 13148 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
cagcactttgggaggccgag

SEQ ID NO: 13149 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
actttgggaggccgagggga

SEQ ID NO: 13150 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
agctactcaagaggctgaga

SEQ ID NO: 13151 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
ggatgtttgcttgagcccct

SEQ ID NO: 13152 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
actgcactcagcctgggaga

SEQ ID NO: 13153 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
tagatgctttataatgtaaa

SEQ ID NO: 13154 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
ttacttgtgagataacagat

SEQ ID NO: 13155 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gataacagattaggatcatg

SEQ ID NO: 13156 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gaaatgctaagtctttttac

SEQ ID NO: 13157 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
attgatcacatcacattact

SEQ ID NO: 13158 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
gataccattaactatcacct

SEQ ID NO: 13159 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
actatcacctgggagtcaac

SEQ ID NO: 13160 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tccttcaagtcatccgccat

SEQ ID NO: 13161 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttagaattgtttaaccttgc

SEQ ID NO: 13162 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
cagtgtaagacagaaagcat

SEQ ID NO: 13163 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
agatttgagctgattttatt

SEQ ID NO: 13164 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
gaatataccccaattactcc

SEQ ID NO: 13165 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
tattacagcctgtgtataag

SEQ ID NO: 13166 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tgggtatctagtggcttcag

SEQ ID NO: 13167 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
tttaactatcatccatgtgg

SEQ ID NO: 13168 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aatgactgctatataatgcc

SEQ ID NO: 13169 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
actgctatataatgccctga

SEQ ID NO: 13170 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ctatataatgccctgaatga

SEQ ID NO: 13171 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ctgaatgaatgaatcaatca

SEQ ID NO: 13172 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tggtactcaatgttctttca

SEQ ID NO: 13173 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
tttcacagaatctctatttt

SEQ ID NO: 13174 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
acatcatgacaaaattagta

SEQ ID NO: 13175 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tatcctcattttaattcatg

SEQ ID NO: 13176 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
atgttcatttgagatagatc

SEQ ID NO: 13177 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
aacaaaaaaaagtagggaaa

SEQ ID NO: 13178 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tctttttattttcatcccaa

SEQ ID NO: 13179 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ccaatattactgaaaaacaa

SEQ ID NO: 13180 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aactgaatctagcttcctcc

SEQ ID NO: 13181 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
ctagcttcctccctgaattt

SEQ ID NO: 13182 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttgaaacaacaaagatggag

SEQ ID NO: 13183 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gaagaataccttactgaaat

SEQ ID NO: 13184 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
accttactgaaatatgaata

SEQ ID NO: 13185 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tctcctgctcctctgggctt

SEQ ID NO: 13186 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttgtattaccacttcgtgaa

SEQ ID NO: 13187 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gagtaaacaagcaagaaaac

SEQ ID NO: 13188 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aagaccataggccataaaaa

SEQ ID NO: 13189 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
catacttgtcttggaaaagc

SEQ ID NO: 13190 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgctattgtttgacaccaaa

SEQ ID NO: 13191 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
atcattgttctctctaaagc

SEQ ID NO: 13192 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
tctaaagcgtgggttcaggt

SEQ ID NO: 13193 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ctagacagaactctgaagag

SEQ ID NO: 13194 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
tcaaatgaaaaaataaaata

SEQ ID NO: 13195 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
taaaatagggaattgggact

SEQ ID NO: 13196 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
atagggaattgggactggga

SEQ ID NO: 13197 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tacagtgatgctgaactaat

SEQ ID NO: 13198 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
gtgtttagagagaacataag

SEQ ID NO: 13199 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
aacataagaagagtaaattt

SEQ ID NO: 13200 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tctttcttcttattctcctt

SEQ ID NO: 13201 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ctttgggatcttttattttt

SEQ ID NO: 13202 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
aggacatcaagtaattattt

SEQ ID NO: 13203 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
atagcattgtcctaaatcca

SEQ ID NO: 13204 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gtcctaaatccagagggttc

SEQ ID NO: 13205 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
tagaaagctcttgacaccca

SEQ ID NO: 13206 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
cctggttggggaggaaagcc

SEQ ID NO: 13207 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gccttgagttctgtgctatt

SEQ ID NO: 13208 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
ctactattccatcatttttc

SEQ ID NO: 13209 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
caggaagtgtctaaattacc

SEQ ID NO: 13210 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ggcatttaaagttcatgcca

SEQ ID NO: 13211 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aaggtcatgaagagacaaag

SEQ ID NO: 13212 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
aatatttaaaaaaaaacaca

SEQ ID NO: 13213 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGAGT
taaaaaaaaacacataggat

SEQ ID NO: 13214 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
tacatggtgtctagtcatat

SEQ ID NO: 13215 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
ctccagagaggaagaggcaa

SEQ ID NO: 13216 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gtacatttttcctacaaact

SEQ ID NO: 13217 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ccatttactccctgggaact

SEQ ID NO: 13218 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
tactccctgggaactcagaa

SEQ ID NO: 13219 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ctctcattttgtcttatcca

SEQ ID NO: 13220 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
cacagaatatatagtactgt

SEQ ID NO: 13221 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
agtggcttctcaatagctta

SEQ ID NO: 13222 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
cttccctcaggagccagtcc

SEQ ID NO: 13223 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGGT
ttaaacctccaaagtagtgg

SEQ ID NO: 13224 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tcctcggaaggctgaggcag

SEQ ID NO: 13225 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
gagatcacgccattgcactt

SEQ ID NO: 13226 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tactcccatatttagcccaa

SEQ ID NO: 13227 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aggaaacagaaaaagtgaga

SEQ ID NO: 13228 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaaagtcacaaagttatgta

SEQ ID NO: 13229 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
tccacttcattttgcaattt

SEQ ID NO: 13230 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gtactgttaattctgaaaat

SEQ ID NO: 13231 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
agggcaatgcattataaggc

SEQ ID NO: 13232 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
actttggaaggccgaggcag

SEQ ID NO: 13233 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
caggtggatcacctgaagtc

SEQ ID NO: 13234 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tactcaggaggctgaggcag

SEQ ID NO: 13235 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tgcactccagcctgggcaac

SEQ ID NO: 13236 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tatgattctattattcctgc

SEQ ID NO: 13237 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGAT
gagattatcagaaaaactat

SEQ ID NO: 13238 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aactatggggatgcccctcc

SEQ ID NO: 13239 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ccttcatctctgctgatttt

SEQ ID NO: 13240 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttttaggaattcagaaattt

SEQ ID NO: 13241 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gaagttttgatttggggaag

SEQ ID NO: 13242 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
gaagaggaattagtatgcat

SEQ ID NO: 13243 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ccactattatcctagacaca

SEQ ID NO: 13244 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gacacattgaattgagctct

SEQ ID NO: 13245 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttagaattttgtctgtaaat

SEQ ID NO: 13246 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
atcaaaagatggttataact

SEQ ID NO: 13247 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tataactaagagtaagaaac

SEQ ID NO: 13248 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGAAT
atttcaactacaaatataaa

SEQ ID NO: 13249 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tttaacaaaaaaagcttttt

SEQ ID NO: 13250 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aaaagctttttcagagtgct

SEQ ID NO: 13251 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gacacaaaggcttccaaggg

SEQ ID NO: 13252 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agcatgaaaagcctaaaaag

SEQ ID NO: 13253 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
caaaacaaaaacccacacat

SEQ ID NO: 13254 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgcttcctgcaactgagctg

SEQ ID NO: 13255 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
gcaactgagctgaggaattt

SEQ ID NO: 13256 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
ttctttttcaagcaaaagat

SEQ ID NO: 13257 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
atatttaatcactttatcta

SEQ ID NO: 13258 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tcagagaagcagagctggtg

SEQ ID NO: 13259 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
gctggtggagaattccctgg

SEQ ID NO: 13260 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tcagtctttgctatggacaa

SEQ ID NO: 13261 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
ccatccaagtcattagtctt

SEQ ID NO: 13262 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
caagtcattagtcttggggg

SEQ ID NO: 13263 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
attggaaacaaatctcatta

SEQ ID NO: 13264 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tcatcaacctgataccatct

SEQ ID NO: 13265 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agtaaaaaatgtaagtgagc

SEQ ID NO: 13266 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gtaagtgtgcctattataat

SEQ ID NO: 13267 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tagataaatctatactactc

SEQ ID NO: 13268 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
ctcatggatttatctgactt

SEQ ID NO: 13269 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
gattaaaaatgttttctcca

SEQ ID NO: 13270 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
tcttagttgcagtaacattg

SEQ ID NO: 13271 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tcaaactgaaaagtaagaca

SEQ ID NO: 13272 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGGGT
ctatgagcattcaactgaaa

SEQ ID NO: 13273 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ccttgttagtgctttttaac

SEQ ID NO: 13274 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aaaccaagatttaaaagttc

SEQ ID NO: 13275 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
tgggcagatcacttgaggtc

SEQ ID NO: 13276 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ccttcaaaaatacaaaaata

SEQ ID NO: 13277 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttgcctaacaccaagcaagt

SEQ ID NO: 13278 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ctacagctccccactatgta

SEQ ID NO: 13279 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGAT
ctgccagcagtcccctaaat

SEQ ID NO: 13280 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ataaaattgttaaatgcttg

SEQ ID NO: 13281 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ctgatatgtgcaaaaaatat

SEQ ID NO: 13282 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
aaggttaaaagtttggtcag

SEQ ID NO: 13283 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
aagtttaaaattctctaatt

SEQ ID NO: 13284 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
agttgcacatgtgactaatt

SEQ ID NO: 13285 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atttggggttattaatatgg

SEQ ID NO: 13286 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tggctaatttttttttttaa

SEQ ID NO: 13287 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tctctctctgtcacccaggc

SEQ ID NO: 13288 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
cctctgcctcttggcagcac

SEQ ID NO: 13289 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
aaaacgtttttatctaaaat

SEQ ID NO: 13290 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
cattattttcttgtttgcca

SEQ ID NO: 13291 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
ccaagggattgtgtgtgtgt

SEQ ID NO: 13292 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tgggtgtgtgtgcacacgct

SEQ ID NO: 13293 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
actaaaactggttttcaaaa

SEQ ID NO: 13294 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aatatataattactctttaa

SEQ ID NO: 13295 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tttttgacagattctcagtc

SEQ ID NO: 13296 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ctcactataacctctgcctc

SEQ ID NO: 13297 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
gattctcctgcctcagcctc

SEQ ID NO: 13298 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
ttttgtatttttagtagcga

SEQ ID NO: 13299 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
cagggtttcaccatgttggc

SEQ ID NO: 13300 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gccttggcctcccaaaatgc

SEQ ID NO: 13301 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gaggtttttcacacagtccc

SEQ ID NO: 13302 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ccctggagtcttgtctgagg

SEQ ID NO: 13303 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ctcttttcttttctcagtgt

SEQ ID NO: 13304 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cattcttatatttatttttg

SEQ ID NO: 13305 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
gtaacttttattttaagttc

SEQ ID NO: 13306 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
acacagggaaacttgtgtta

SEQ ID NO: 13307 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttataagtgaggacattctc

SEQ ID NO: 13308 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tatttgtaagacaaatgctt

SEQ ID NO: 13309 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
aatgcttcagagtgaaattg

SEQ ID NO: 13310 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAAT
tttgccataataaaatattg

SEQ ID NO: 13311 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
taacgcctacagggccatag

SEQ ID NO: 13312 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGAAT
acttctccattctttggcca

SEQ ID NO: 13313 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tcactttcccatttcttgta

SEQ ID NO: 13314 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
ctctccccaaacaatgtgtc

SEQ ID NO: 13315 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
ctttgtgagcctaataagtg

SEQ ID NO: 13316 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tttatttatttattttgaga

SEQ ID NO: 13317 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
cgctctctcattgcccaggc

SEQ ID NO: 13318 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
ctcactgcaacatctgcctc

SEQ ID NO: 13319 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
agttctcctgcctcagcctc

SEQ ID NO: 13320 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGGAT
gcctcagcctcctgagtagc

SEQ ID NO: 13321 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
atctcagcttcccaaagtgc

SEQ ID NO: 13322 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
tttagtttgcattttctttt

SEQ ID NO: 13323 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tttcttttgtgagtgaggtc

SEQ ID NO: 13324 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gcatctacattttaattaaa

SEQ ID NO: 13325 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
gtacttcataagtgtgatga

SEQ ID NO: 13326 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tgattccactaaaatgtatc

SEQ ID NO: 13327 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttaggtggcaaagcagtaat

SEQ ID NO: 13328 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
atatgtaactatgtctattt

SEQ ID NO: 13329 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
cataaaataacattatgtat

SEQ ID NO: 13330 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
atttctatttttattttcat

SEQ ID NO: 13331 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
atcagtttaataacttcaac

SEQ ID NO: 13332 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
gattattaaaatattgtgat

SEQ ID NO: 13333 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGAT
actttgggaagccgaggcag

SEQ ID NO: 13334 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
caggcggatcacctgaggtc

SEQ ID NO: 13335 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
gaactgcttgaacccgggag

SEQ ID NO: 13336 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ggcaccaggcagacttaggt

SEQ ID NO: 13337 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tgtcttataaagttatcatg

SEQ ID NO: 13338 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaatttttaaataataagcc

SEQ ID NO: 13339 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
aaccttacgaaaatcttatg

SEQ ID NO: 13340 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
agttgttaaattcatggctc

SEQ ID NO: 13341 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ggctccagagtgagagaggc

SEQ ID NO: 13342 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
cttactagcttatgtccttg

SEQ ID NO: 13343 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
ttagtggaaaaaattagaca

SEQ ID NO: 13344 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
aagctaatgttcttaggaac

SEQ ID NO: 13345 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ttcttagggagctttcaact

SEQ ID NO: 13346 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
attagtttattcagtgtcta

SEQ ID NO: 13347 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
atccatcaggtttgataaat

SEQ ID NO: 13348 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
gtggatacactgaacacacc

SEQ ID NO: 13349 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
agatttaataacaaaaacat

SEQ ID NO: 13350 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
gatgaccctctaggactgag

SEQ ID NO: 13351 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaaaatgaaaatgctctagc

SEQ ID NO: 13352 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aaatgctctagcatgagtca

SEQ ID NO: 13353 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGAT
cagaggatttttcattagca

SEQ ID NO: 13354 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgaaatattcctgatggggc

SEQ ID NO: 13355 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
ttaattcaatatcaaaataa

SEQ ID NO: 13356 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ttttgatgaagacattgttt

SEQ ID NO: 13357 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
aatctatattagcaaaggaa

SEQ ID NO: 13358 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
gaagggggtaatctggtttg

SEQ ID NO: 13359 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
agtactatggtataaataac

SEQ ID NO: 13360 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
aggaaccctcaccataatct

SEQ ID NO: 13361 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
taaaaatatattcaaagata

SEQ ID NO: 13362 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
aagggtatggctattttttt

SEQ ID NO: 13363 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gtatggctatttttttaagg

SEQ ID NO: 13364 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tactttctgccattttgggg

SEQ ID NO: 13365 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
cagaacctcacagatataaa

SEQ ID NO: 13366 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ctcacagatataaataggat

SEQ ID NO: 13367 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
taaataggattggagtcatg

SEQ ID NO: 13368 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tccaaattagataacaatca

SEQ ID NO: 13369 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
taacaatcacaggatcacaa

SEQ ID NO: 13370 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
cctaaacatttgctttatct

SEQ ID NO: 13371 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
gatcaaatttatattccaga

SEQ ID NO: 13372 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ttattatttttaaatttatt

SEQ ID NO: 13373 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tataactttgaccaggaggc

SEQ ID NO: 13374 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tctttttattattctaactg

SEQ ID NO: 13375 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gcaaaatttacttagtgacc

SEQ ID NO: 13376 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
ctaggggacttaacctccac

SEQ ID NO: 13377 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
ctgaaaacactttaacaaaa

SEQ ID NO: 13378 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
agccttgtaaaatggtctgt

SEQ ID NO: 13379 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tggattacaactacagcaca

SEQ ID NO: 13380 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
ttgtttgatttaatcatatc

SEQ ID NO: 13381 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
atatctaggattagaaaatg

SEQ ID NO: 13382 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aattcattaactagctaggc

SEQ ID NO: 13383 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
caaggatattctttcccatc

SEQ ID NO: 13384 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
agaacaaaacaaaatgaaat

SEQ ID NO: 13385 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tgaaatggaaggcacatgtt

SEQ ID NO: 13386 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
aaaccagatctctggggaca

SEQ ID NO: 13387 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
gggaaagctggaaactctct

SEQ ID NO: 13388 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ACGAAT
tggaaactctcttagagtct

SEQ ID NO: 13389 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
ttagagtctacgaattatat

SEQ ID NO: 13390 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
gaatttttaaaaaatcacca

SEQ ID NO: 13391 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tgaatcacagacctaaacgt

SEQ ID NO: 13392 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tcaacaaaagaaaaaaagag

SEQ ID NO: 13393 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
aaaagaaaaaaagagctgaa

SEQ ID NO: 13394 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
tgcaaatcatatatctgata

SEQ ID NO: 13395 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
aagcagattaaaaatgaaca

SEQ ID NO: 13396 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGGAT
aaatatcacttcacacttgg

SEQ ID NO: 13397 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
aaaggaaaagaaacattgac

SEQ ID NO: 13398 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aacccttgtgcattgctgat

SEQ ID NO: 13399 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
atgatccagcaattctactt

SEQ ID NO: 13400 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
aatactacacagccttaaaa

SEQ ID NO: 13401 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGAT
attctgatatatgctacgac

SEQ ID NO: 13402 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
acatgaaaagacaaatgcta

SEQ ID NO: 13403 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
ttccacttacatgaggtacc

SEQ ID NO: 13404 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
agtcacattcatagagaaag

SEQ ID NO: 13405 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
agaaagtagaatagtggtta

SEQ ID NO: 13406 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
actgggtgataggggaagag

SEQ ID NO: 13407 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gataggggaagagaggagtg

SEQ ID NO: 13408 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGAGT
gagtcattgtttaatagtta

SEQ ID NO: 13409 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
atagttaccgagtttttgtt

SEQ ID NO: 13410 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
atgatgaaaatgttctgaag

SEQ ID NO: 13411 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
tggtggtgatcgtgtacaac

SEQ ID NO: 13412 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tttgagatccgtaaggcaga

SEQ ID NO: 13413 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cccaaatagtaagaggttcc

SEQ ID NO: 13414 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
caatccattacagacaggaa

SEQ ID NO: 13415 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
caattgctgttttttgtgac

SEQ ID NO: 13416 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
gcatatcttatggtacaatg

SEQ ID NO: 13417 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGAAT
tggtacaatgatggatagtg

SEQ ID NO: 13418 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aagaaagagggaaggaaaga

SEQ ID NO: 13419 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aattgcttttaaattccagg

SEQ ID NO: 13420 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
ggaagagtataaatgctgag

SEQ ID NO: 13421 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
atgctgagaggagtgaggtt

SEQ ID NO: 13422 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
cagccgcttaccactgccct

SEQ ID NO: 13423 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
tcaatggcaccaataccaac

SEQ ID NO: 13424 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGAT
cattttggaggccaactaga

SEQ ID NO: 13425 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ttttatctgttgatgatcat

SEQ ID NO: 13426 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gttttcatatttttgctatt

SEQ ID NO: 13427 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tgagattctgatttcaattg

SEQ ID NO: 13428 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
aaccttaaccacttagtcta

SEQ ID NO: 13429 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
tcccaaagtacagtatctaa

SEQ ID NO: 13430 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
aatttaactgacttagataa

SEQ ID NO: 13431 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
atatttgtactcctccaata

SEQ ID NO: 13432 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
acttctccatctgctagctc

SEQ ID NO: 13433 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tccctgtttcttctccattt

SEQ ID NO: 13434 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tttaattttttttcttgaga

SEQ ID NO: 13435 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
tctcgctctgttgcccaggc

SEQ ID NO: 13436 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
acaggtgctggccaccatgc

SEQ ID NO: 13437 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tgtattttttttagtagaga

SEQ ID NO: 13438 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
tgcctcagccttccaaagtg

SEQ ID NO: 13439 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGAAT
ttaatgttaaaacaaaatat

SEQ ID NO: 13440 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
cttaacacaatatacccctc

SEQ ID NO: 13441 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
aattttattttagctccatt

SEQ ID NO: 13442 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
taagggttaaacatatttga

SEQ ID NO: 13443 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
aaccaccaggtatatctgtg

SEQ ID NO: 13444 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
ggtatgtgcaaacgtattct

SEQ ID NO: 13445 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
attcaagtttagtaaccatt

SEQ ID NO: 13446 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGAT
tcacctcaaatggtggtcat

SEQ ID NO: 13447 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgggcagatcacctgaggtc

SEQ ID NO: 13448 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tacttgggaggctgaggcag

SEQ ID NO: 13449 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ggctgaggcaggagaatcac

SEQ ID NO: 13450 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
ctgcactccagcctgggcaa

SEQ ID NO: 13451 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
cgggcagatcacctgaactc

SEQ ID NO: 13452 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tactcgggaggctgaggcag

SEQ ID NO: 13453 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
tgcactccagcctgggcaac

SEQ ID NO: 13454 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tcggtctcaaaaaaaaaaaa

SEQ ID NO: 13455 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tatttgactaagaccacata

SEQ ID NO: 13456 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
aagtctgtcagctgatctca

SEQ ID NO: 13457 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
accttattcccagttgatcc

SEQ ID NO: 13458 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gccacttccctttttcctac

SEQ ID NO: 13459 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
ccatgagccaagtttgtaaa

SEQ ID NO: 13460 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aagtttgtaaatggggtaac

SEQ ID NO: 13461 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tcccataatatttacctaga

SEQ ID NO: 13462 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
acactgtctattagacttga

SEQ ID NO: 13463 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
cccaggctgatctagaactc

SEQ ID NO: 13464 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGAT
gcctcggcctcccaaagtga

SEQ ID NO: 13465 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
tcccaaagtgatgggattgc

SEQ ID NO: 13466 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tccctgttttactcatctgc

SEQ ID NO: 13467 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttttactcatctgcatggat

SEQ ID NO: 13468 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
atatttttaaaataattaca

SEQ ID NO: 13469 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGGAT
actttgggaggtcgaggcgg

SEQ ID NO: 13470 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ctactcggaggctgaggcag

SEQ ID NO: 13471 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
aataaaaaataaaaaaaaaa

SEQ ID NO: 13472 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAGT
tttaaaaatcagataataca

SEQ ID NO: 13473 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
atttttattaaaaatcttat

SEQ ID NO: 13474 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ctaatagtttgacctaaaag

SEQ ID NO: 13475 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
aaagggcattcattgcaggg

SEQ ID NO: 13476 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
taacaagaggaaatcataaa

SEQ ID NO: 13477 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tctatagaactaaaaagata

SEQ ID NO: 13478 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
catttttcctcaccacccag

SEQ ID NO: 13479 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
ccttccagcaaggcagagga

SEQ ID NO: 13480 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatgaagaaatttcattttt

SEQ ID NO: 13481 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aagtattctacccacattct

SEQ ID NO: 13482 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gatgtcataatacttctgta

SEQ ID NO: 13483 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
aagtgtgtgtgtgtgtgtgt

SEQ ID NO: 13484 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAGT
gtgtgtgtgtgtgtgtgagt

SEQ ID NO: 13485 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
cttccactctaataacagtg

SEQ ID NO: 13486 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
aataacagtgatgggtcttc

SEQ ID NO: 13487 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
gcctctctgaaccttcctta

SEQ ID NO: 13488 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ttagagaatgcttcaaatat

SEQ ID NO: 13489 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agcatctatgtttattttaa

SEQ ID NO: 13490 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
caaggttatcattttagatt

SEQ ID NO: 13491 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tttgtggtcactgcctttct

SEQ ID NO: 13492 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
tcacctacactgataaaaga

SEQ ID NO: 13493 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
ataaaagagagaatacatct

SEQ ID NO: 13494 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aatgcttgacaaataaaaaa

SEQ ID NO: 13495 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
aatcacaaaattcatgtttc

SEQ ID NO: 13496 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
gttaatatgctttattctgg

SEQ ID NO: 13497 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGGT
gtcaacaatgaagacatagt

SEQ ID NO: 13498 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
agacatagtctgggttccct

SEQ ID NO: 13499 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TCGAGT
ctttccaaaacaaaaaaacc

SEQ ID NO: 13500 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAGT
ttgagatttaaagtttaaga

SEQ ID NO: 13501 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
taagaaggagtaagcacgca

SEQ ID NO: 13502 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
cagcatttgaaaaggcctta

SEQ ID NO: 13503 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
caggagcaccttaatgagaa

SEQ ID NO: 13504 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
tggagagaagggacagaaca

SEQ ID NO: 13505 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
ccaatgtttgttaggggaga

SEQ ID NO: 13506 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAAT
ggatggtattgctttgtata

SEQ ID NO: 13507 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAAT
ggtattgctttgtatagaga

SEQ ID NO: 13508 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
gattgatatggaggctgtgg

SEQ ID NO: 13509 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
ggccgtgtagatacagaaaa

SEQ ID NO: 13510 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGAAT
gtgtagatacagaaaagagg

SEQ ID NO: 13511 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
caggctggaaagggctgaaa

SEQ ID NO: 13512 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
atcaaaggtgatttcaatac

SEQ ID NO: 13513 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
agataatgaagatgggagga

SEQ ID NO: 13514 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tgggaggaaagaatctgaga

SEQ ID NO: 13515 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
attattatcattatgacatc

SEQ ID NO: 13516 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
cactcttttgcataactaat

SEQ ID NO: 13517 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
ataactaataggaatagaaa

SEQ ID NO: 13518 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
ttttccttgccacagagaaa

SEQ ID NO: 13519 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gaaccctactgattgctctt

SEQ ID NO: 13520 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
tgagcctagccctgcaccat

SEQ ID NO: 13521 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
gtcactgtaaaaacacatca

SEQ ID NO: 13522 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
atcaaataccatattctgtc

SEQ ID NO: 13523 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
atcatgaaaatttgcgacac

SEQ ID NO: 13524 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
taaatagtggaaaaaatctg

SEQ ID NO: 13525 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGAT
taaaatgaacagtttaataa

SEQ ID NO: 13526 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
acagggaagaagaaatagaa

SEQ ID NO: 13527 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
atgtaaattgctcttaacat

SEQ ID NO: 13528 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
aaaaaaaaaaaactaaaata

SEQ ID NO: 13529 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttcttgttctgatttttgtc

SEQ ID NO: 13530 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGAGT
ccattttttcctaaaagtaa

SEQ ID NO: 13531 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
aagtaaatgagtttcccaag

SEQ ID NO: 13532 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tgaattcgataaaaagttaa

SEQ ID NO: 13533 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
aaaaggattctgcatctttt

SEQ ID NO: 13534 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGGT
tttgtgtttgtgtgctctta

SEQ ID NO: 13535 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGGGT
ttgtgtgctcttaaggggtg

SEQ ID NO: 13536 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
taaaaaatgtgagctgcccc

SEQ ID NO: 13537 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
agaacctggcagcaaaccca

SEQ ID NO: 13538 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
tctttccaggtggcgtaata

SEQ ID NO: 13539 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGGT
agatgtgaaaatagacacag

SEQ ID NO: 13540 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
atccccacccagtgcacctg

SEQ ID NO: 13541 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CGGAAT
cccagcctcagccgagctgg

SEQ ID NO: 13542 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CCGGGT
ctccactcctcccagcgcgc

SEQ ID NO: 13543 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGGGT
cgctaatagaaggcggagga

SEQ ID NO: 13544 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
ctgccatccacggccaccca

SEQ ID NO: 13545 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
tgggtggggcgtgtgtgtgt

SEQ ID NO: 13546 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
tttcctcccttcctgctcag

SEQ ID NO: 13547 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tggggaccaatggcaaagcc

SEQ ID NO: 13548 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ctccccgaccttgggctctg

SEQ ID NO: 13549 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GGGAAT
ggctctgaagagtctaggct

SEQ ID NO: 13550 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GCGAGT
gtagggctttgctcacaacc

SEQ ID NO: 13551 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
atatgtatatataaaatcaa

SEQ ID NO: 13552 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
tttctttcgaagatgcagtg

SEQ ID NO: 13553 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
cagacctgggacccgattat

SEQ ID NO: 13554 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
ctgaatatgccatcagtcat

SEQ ID NO: 13555 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tgccatcagtcatatgggtt

SEQ ID NO: 13556 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
ttttaaaaattcattttgtg

SEQ ID NO: 13557 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
gggaggaagaacaatggaaa

SEQ ID NO: 13558 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
gaagaacaatggaaacaggg

SEQ ID NO: 13559 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGAT
tccaccaagggaagaaatca

SEQ ID NO: 13560 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
atcaaaggatggccataggg

SEQ ID NO: 13561 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
caaaagggcagaccactttg

SEQ ID NO: 13562 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGGT
accggaaggaaatcaaatcc

SEQ ID NO: 13563 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
ttggtggtagatataggaag

SEQ ID NO: 13564 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
aagaagagttcaactgcaat

SEQ ID NO: 13565 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGGGT
gttcacagcaaaactgaagg

SEQ ID NO: 13566 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
cataaccgctactcccacac

SEQ ID NO: 13567 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
ccattatcaacattccccac

SEQ ID NO: 13568 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGGT
caaggtctgtagttcacatt

SEQ ID NO: 13569 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGGGT
tcatggtgttgtccattcta

SEQ ID NO: 13570 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAGT
tccaccattacagtatctta

SEQ ID NO: 13571 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
agagtaatttcagttctctc

SEQ ID NO: 13572 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
ctttatagttttgccttctc

SEQ ID NO: 13573 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
atcctatagttgcaataata

SEQ ID NO: 13574 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
tagctcatttctttacagtg

SEQ ID NO: 13575 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tggacatgttttcaagtcct

SEQ ID NO: 13576 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aacatcaaggagcacaattg

SEQ ID NO: 13577 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
caattgctggatcatatggt

SEQ ID NO: 13578 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
cattcccaccagcaatacat

SEQ ID NO: 13579 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
aacttgatatcatcagtgtt

SEQ ID NO: 13580 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GTGGAT
tttcccctgtgatatatgat

SEQ ID NO: 13581 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
tatatggcccatttttttca

SEQ ID NO: 13582 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
ggttatttcttttcttgttg

SEQ ID NO: 13583 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
tatgcctttgctgttatatc

SEQ ID NO: 13584 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAGT
acatatgttagatacattct

SEQ ID NO: 13585 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAAT
tgttagatacattcttagag

SEQ ID NO: 13586 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aaatcctcttggtctgactg

SEQ ID NO: 13587 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGGAT
tctgactgagggatcccttg

SEQ ID NO: 13588 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
atactacactgcacagcctt

SEQ ID NO: 13589 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
gatggtacgtttaaaattta

SEQ ID NO: 13590 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAAT
ttaaaatttaaagggtaggc

SEQ ID NO: 13591 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGAGT
gatagaaaaatgtggaaatg

SEQ ID NO: 13592 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CAGAAT
taacatcatacaatccatac

SEQ ID NO: 13593 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGAAT
catacaatccataccagaat

SEQ ID NO: 13594 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
atccataccagaataggaat

SEQ ID NO: 13595 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGAT
tttcccttagtgagaaataa

SEQ ID NO: 13596 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
taaaattaatacaatactga

SEQ ID NO: 13597 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
tttgtttttctctaattaaa

SEQ ID NO: 13598 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
ttattctgttgtgaaaatag

SEQ ID NO: 13599 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGGAT
gtgtatacatagctaaaaag

SEQ ID NO: 13600 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
aaattataactaaaaagaaa

SEQ ID NO: 13601 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
gaagattatcagacatagat

SEQ ID NO: 13602 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAGT
tttcctaaatgtattggcat

SEQ ID NO: 13603 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
ctcgtctaatttgacgtggt

SEQ ID NO: 13604 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAAT
taattgattacttattcctg

SEQ ID NO: 13605 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: ATGGGT
cccagtgtcatagtccactg

SEQ ID NO: 13606 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TGGAGT
tgctgataatgtgctttctg

SEQ ID NO: 13607 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGAGT
aacatgaagagccagaaaat

SEQ ID NO: 13608 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TAGAAT
gtttgataggctgagggagc

SEQ ID NO: 13609 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: GAGAGT
taagacaagggagctgaaca

SEQ ID NO: 13610 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AGGGAT
aaaattcttggacctcacac

SEQ ID NO: 13611 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: TTGGGT
acctcaaaacacaggagata

SEQ ID NO: 13612 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: AAGGGT
atattgggtagactctgcag

SEQ ID NO: 13613 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGAAT
gtcttatcttagcagtgggg

SEQ ID NO: 13614 - DNA, 20 bp, synthetic construct
  source 1..20: mol_type = other DNA; note = Description of Artificial Sequence: Synthetic oligonucleotide; note = Target: SCN9A; (+) strand; PAM type: NNGRRT; PAM sequence: CTGGAT
taactttaactaacgttgct

SEQ ID NO: 13615 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
taaccgacattaccttagct

SEQ ID NO: 13616 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGTTT
tggctgtcctgtgcatggtg

SEQ ID NO: 13617 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGTTT
gacatttatttctctaaggc

SEQ ID NO: 13618 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGCTT
agttaaaagtgtttttcctc

SEQ ID NO: 13619 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
tttttgaaggactaagttaa

SEQ ID NO: 13620 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGTTT
tttcacatggtaagttgagt

SEQ ID NO: 13621 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGCTT
cttacattcttatacagtgc

SEQ ID NO: 13622 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
ttcagcctcaatagttttct

SEQ ID NO: 13623 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
aatctgtgtgcttcagcctc

SEQ ID NO: 13624 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGCTT
ctctttccctatcttaatct

SEQ ID NO: 13625 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGCTT
tattactgtctacaagttct

SEQ ID NO: 13626 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGATT
ataaattctaaaatcctcag

SEQ ID NO: 13627 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGCTT
tttatgaggttgtgacattt

SEQ ID NO: 13628 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGATT
attctcagtacagtagccag

SEQ ID NO: 13629 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGTTT
ataagacaatgtaataacct

SEQ ID NO: 13630 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
ttgattagtaccaccattca

SEQ ID NO: 13631 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
ataaattacatcttccttct

SEQ ID NO: 13632 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGATT
gtataagagatttgagcatc

SEQ ID NO: 13633 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGATT
aaacactatgccatttgtat

SEQ ID NO: 13634 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGATT
catatccatggtttctgatc

SEQ ID NO: 13635 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGTTT
tgcattcagtcctccatatc

SEQ ID NO: 13636 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGATT
agttcccgaggctgaggagt

SEQ ID NO: 13637 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
actcaggagtcagagataat

SEQ ID NO: 13638 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGCTT
ataattcactttagcatgtt

SEQ ID NO: 13639 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
aacgtttcatttggaacata

SEQ ID NO: 13640 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAACGTTT
tctacagcaaatgtcttcta

SEQ ID NO: 13641 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCGTGTTT
ctccctgttgactatcctaa

SEQ ID NO: 13642 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGATT
tcttatcaaaaatttaaagg

SEQ ID NO: 13643 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGTTT
aaagagagggacactggtga

SEQ ID NO: 13644 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
gatcaaacacaaatgcatgc

SEQ ID NO: 13645 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
tacattgacaatatgttaaa

SEQ ID NO: 13646 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGATT
ggcccttcatctgaggagcc

SEQ ID NO: 13647 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
acataatctggatttgcatg

SEQ ID NO: 13648 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGATT
ctaaatatgtgagaacataa

SEQ ID NO: 13649 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGTTT
tgtaatatttgctggcatga

SEQ ID NO: 13650 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGCTT
ataagtatacagaaaatgtt

SEQ ID NO: 13651 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
taataactgcatcattgcac

SEQ ID NO: 13652 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGATT
gtctgcgaaaaggtaatttg

SEQ ID NO: 13653 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGCTT
aatagagctcacatgctaca

SEQ ID NO: 13654 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGGGATT
ttacatactagctagagcag

SEQ ID NO: 13655 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
actgtaatccatttcaacat

SEQ ID NO: 13656 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGCTT
aatatgcacatttataaagg

SEQ ID NO: 13657 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGATT
atttcaaaatttagctactt

SEQ ID NO: 13658 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGTTT
agtataactatagtgcccaa

SEQ ID NO: 13659 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGCTT
ggttgtaatgatagaatgag

SEQ ID NO: 13660 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
cccagttaagccatgaccct

SEQ ID NO: 13661 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGCTT
tcattgttctaatttctttg

SEQ ID NO: 13662 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
ctattactactaatataaat

SEQ ID NO: 13663 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGATT
cctgtatgacacagaagtag

SEQ ID NO: 13664 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGCTT
gtgtagcatacataatggct

SEQ ID NO: 13665 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGTTT
taatttcttgaaatccacat

SEQ ID NO: 13666 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGCTT
tttttccttttcattgaaag

SEQ ID NO: 13667 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGCTT
ctaaataagttgcaacaact

SEQ ID NO: 13668 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
aaattatgtttacacgtatt

SEQ ID NO: 13669 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
aaaagttatacaaaataaaa

SEQ ID NO: 13670 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
tctatgaatgctcaaaatgt

SEQ ID NO: 13671 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
catagatctatgaatgctca

SEQ ID NO: 13672 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGATT
aatatcataaagctgtttac

SEQ ID NO: 13673 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGTTT
aatagccatgaatatcataa

SEQ ID NO: 13674 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGCTT
tcttgaggaaaacaatcaag

SEQ ID NO: 13675 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
accaattttttaaaaatatc

SEQ ID NO: 13676 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
aggatggccagggaattggc

SEQ ID NO: 13677 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGCTT
gcatgattttatagagtttt

SEQ ID NO: 13678 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGTTT
aaatacttagcatgatttta

SEQ ID NO: 13679 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
atcacaacccaaaatactta

SEQ ID NO: 13680 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGATT
acttgtgagctgtttttaaa

SEQ ID NO: 13681 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGTTT
aaagatttgggtgacttgtg

SEQ ID NO: 13682 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
ttgatagttacctagtttgc

SEQ ID NO: 13683 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGTTT
ttttagctttttgatagtta

SEQ ID NO: 13684 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
tgaaaattagagaacctaat

SEQ ID NO: 13685 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
catgagccaccatgccccaa

SEQ ID NO: 13686 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGCTT
gcccaggctagtctcaaact

SEQ ID NO: 13687 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
ttagaataaaatggaagcaa

SEQ ID NO: 13688 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGTTT
tgtagattactgtttgtact

SEQ ID NO: 13689 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
acctctctttccatgtagat

SEQ ID NO: 13690 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
aaattagacctctctttcca

SEQ ID NO: 13691 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGCTT
gaagaaagagcttattaagt

SEQ ID NO: 13692 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGCTT
taaaaataatatttggaaga

SEQ ID NO: 13693 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
taagttttatatatatttac

SEQ ID NO: 13694 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTACGTTT
tggttaagttttatatatat

SEQ ID NO: 13695 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
ttttttttaaaataacatgg

SEQ ID NO: 13696 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
tctttttcctatttcatgaa

SEQ ID NO: 13697 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGTTT
taaaataaaaaatatgggca

SEQ ID NO: 13698 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
ctattaatgtttttacattg

SEQ ID NO: 13699 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
gttcgtgtgtaattttctat

SEQ ID NO: 13700 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
ttacataatgtagtaagaca

SEQ ID NO: 13701 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGATT
atacaaaatatattacattt

SEQ ID NO: 13702 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
acctaccaagcctgttggaa

SEQ ID NO: 13703 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
ttaatatgaaagacaccatg

SEQ ID NO: 13704 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
tataaaactcaatctagggc

SEQ ID NO: 13705 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
agaatgagatcagaagtcta

SEQ ID NO: 13706 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGATT
tttaaacgtacctatagaaa

SEQ ID NO: 13707 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
ttctggcaatttaaaaagaa

SEQ ID NO: 13708 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ataaattacatttatataat

SEQ ID NO: 13709 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
atataaaacaactttcacta

SEQ ID NO: 13710 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGTTT
ttacttagaagatttttgtg

SEQ ID NO: 13711 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGATT
ggtagaatgtagttttactt

SEQ ID NO: 13712 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
attgagctacacaggtagaa

SEQ ID NO: 13713 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGTTT
taaccataatgctttttttc

SEQ ID NO: 13714 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGCTT
aatttgaaaagaaataacca

SEQ ID NO: 13715 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGTTT
ttttgcattagctgtagaca

SEQ ID NO: 13716 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGCTT
gcctcaatcaacacagtacc

SEQ ID NO: 13717 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGATT
tgaataaaaaagcattgaaa

SEQ ID NO: 13718 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
atgacagactttacacagat

SEQ ID NO: 13719 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGCTT
tgtatacaatcccgtgtttg

SEQ ID NO: 13720 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCGTGTTT
tgcatcacttgtatacaatc

SEQ ID NO: 13721 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
atccttcctgatatgcagtt

SEQ ID NO: 13722 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
tttcctgctttcttatgcag

SEQ ID NO: 13723 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGCTT
taaactcttttgtcaaattt

SEQ ID NO: 13724 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
taagacttacctttagagta

SEQ ID NO: 13725 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tgtaggctattcatttctac

SEQ ID NO: 13726 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGATT
atatgtgcctataaaatgcc

SEQ ID NO: 13727 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGCTT
agaggttattctatattttg

SEQ ID NO: 13728 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGAGCTT
ttagttaaaatgcattatta

SEQ ID NO: 13729 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
aagtaatggacattagttat

SEQ ID NO: 13730 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
tttgccttggctttgcaatg

SEQ ID NO: 13731 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGCTT
aaatcaacaaaagtatttgc

SEQ ID NO: 13732 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
tttcacaggattgtaattag

SEQ ID NO: 13733 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGATT
atctgccttgtcatcttttc

SEQ ID NO: 13734 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
atacaaaagtgattcagttt

SEQ ID NO: 13735 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
attatagcatacaaaagtga

SEQ ID NO: 13736 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
ttattgattatagcatacaa

SEQ ID NO: 13737 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
taagagaactctgtaggaat

SEQ ID NO: 13738 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
gcagatggttatttttgcac

SEQ ID NO: 13739 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGATT
gaaggcagtgcagtcactaa

SEQ ID NO: 13740 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
atattgtttacagcctgtga

SEQ ID NO: 13741 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
atagagcttcatttttgata

SEQ ID NO: 13742 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGCTT
acagcaaggaaagcaaaaaa

SEQ ID NO: 13743 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGCTT
gatttactcaataaaaaaga

SEQ ID NO: 13744 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
ataaaagatggagacagaga

SEQ ID NO: 13745 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACCGCTT
ttcagcgtgcttatagacgt

SEQ ID NO: 13746 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCGTGCTT
gtgtctgctactgtcattca

SEQ ID NO: 13747 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
gttttgggtgagagtgggga

SEQ ID NO: 13748 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCGTGTTT
atcttatttgcttttacaaa

SEQ ID NO: 13749 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
atccattgtcttgacatctt

SEQ ID NO: 13750 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGATT
tttatagagttctctaaact

SEQ ID NO: 13751 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGTTT
gaagtttgatcccgatgcga

SEQ ID NO: 13752 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
gatgttctatgaggtttggg

SEQ ID NO: 13753 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGTTT
gatgactttgagatgttcta

SEQ ID NO: 13754 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
ttacaacctctgctggctgg

SEQ ID NO: 13755 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGATT
ttttgagacctttggcaaca

SEQ ID NO: 13756 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTTGTTT
tttgatgatgtcccttcctg

SEQ ID NO: 13757 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
aaggggatccgcacgctgct

SEQ ID NO: 13758 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAGGATT
gttccgagtgatccgtcttg

SEQ ID NO: 13759 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
tacaggtatgtttctagctg

SEQ ID NO: 13760 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGATT
ccacatacaggtatgtttct

SEQ ID NO: 13761 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGTTT
ttattttcctccacatacag

SEQ ID NO: 13762 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGTTT
agaaatgagttgacagataa

SEQ ID NO: 13763 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGAGCTT
aatggcgtgaacccgggagg

SEQ ID NO: 13764 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
ttctttttagcatttaacgg

SEQ ID NO: 13765 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGATT
atagttattgttgacatttc

SEQ ID NO: 13766 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
acatttgtttgtgtgtgtac

SEQ ID NO: 13767 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
agcttatataacatgaatac

SEQ ID NO: 13768 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
ataaataaataggttacaaa

SEQ ID NO: 13769 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
ccaagatcacaccaccgcac

SEQ ID NO: 13770 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGATT
aatcatttgatcccgggatg

SEQ ID NO: 13771 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
gggcgaaatcacttgaagtc

SEQ ID NO: 13772 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGCTT
cattagaaatgttaattagt

SEQ ID NO: 13773 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
tgcaaataaattacaatagt

SEQ ID NO: 13774 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGATT
taacaaaacacaaggaaaat

SEQ ID NO: 13775 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tgaaagacaaaaaataggtg

SEQ ID NO: 13776 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
tcaaaatctaaagttaaaaa

SEQ ID NO: 13777 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGTTT
tgttcaaatataaaagctca

SEQ ID NO: 13778 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGCTT
agaaaattagggtgacaaga

SEQ ID NO: 13779 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
gacaaaaacaatataagtct

SEQ ID NO: 13780 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGCTT
aaggattgtcatgtacttag

SEQ ID NO: 13781 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
aaagaaagctaaaataattg

SEQ ID NO: 13782 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGATT
tacatgaaaaaaattagaaa

SEQ ID NO: 13783 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGTTT
aaagagtgtgcctgtatcat

SEQ ID NO: 13784 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
tgagaatttcacactaacaa

SEQ ID NO: 13785 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
gagagattatagagattact

SEQ ID NO: 13786 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGATT
cttttaagagagagagatta

SEQ ID NO: 13787 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGATT
aattataaacttttaagaga

SEQ ID NO: 13788 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
cacatatcttgcaaagtatt

SEQ ID NO: 13789 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
ccatggttgtttttctatct

SEQ ID NO: 13790 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
tcctatacattcattgccat

SEQ ID NO: 13791 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGATT
tcatgtctgtgaataacagc

SEQ ID NO: 13792 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGCTT
gaaatgccagttttattttt

SEQ ID NO: 13793 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGTTT
aagttaagatctctagaaat

SEQ ID NO: 13794 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
tagcacatgtgagacttgtc

SEQ ID NO: 13795 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGTTT
atgttgaatctgaaataact

SEQ ID NO: 13796 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
tacctttgcaaaactagtta

SEQ ID NO: 13797 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
ggaaattatacttgttgata

SEQ ID NO: 13798 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
tctctcatactacagtgttt

SEQ ID NO: 13799 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
aatatctgtctctcatacta

SEQ ID NO: 13800 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
gtaggtaagaatatttattt

SEQ ID NO: 13801 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
gaatatttttgattttgtgg

SEQ ID NO: 13802 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
ttcactgtaggatggaatat

SEQ ID NO: 13803 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
gaagttttatattggataaa

SEQ ID NO: 13804 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
ggtcaaagtcaacatatgac

SEQ ID NO: 13805 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
taatttctggataatacttg

SEQ ID NO: 13806 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
aaatatatatatctttagca

SEQ ID NO: 13807 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
tttaactacatttatttttt

SEQ ID NO: 13808 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tggttttaactacatttatt

SEQ ID NO: 13809 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGTTT
agaaagatgtagacaatgat

SEQ ID NO: 13810 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
aatctatagaaagatgtaga

SEQ ID NO: 13811 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
atttaactgtgtttggagac

SEQ ID NO: 13812 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
atttatatatgcacatttaa

SEQ ID NO: 13813 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGATT
aagtacatagtttaaaacaa

SEQ ID NO: 13814 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
agataaaaaagataaaagta

SEQ ID NO: 13815 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGATT
aattgtgaatgggagttcac

SEQ ID NO: 13816 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGATT
gtccttcacatcccttgtaa

SEQ ID NO: 13817 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
cctcttttatttcgctgagc

SEQ ID NO: 13818 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tgagcatggaatattcttcc

SEQ ID NO: 13819 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGCTT
attttgtgaagaaagtcagt

SEQ ID NO: 13820 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
tggttccatatgaactttaa

SEQ ID NO: 13821 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
tccagctttgttctttttgc

SEQ ID NO: 13822 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
gacgcctccagctttgttct

SEQ ID NO: 13823 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
aagtcaggtagtgtgacgcc

SEQ ID NO: 13824 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
tggttactgtagccttgtag

SEQ ID NO: 13825 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
ctgttttggtaccagtacca

SEQ ID NO: 13826 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGTTT
tctgttctgttggtgtatgt

SEQ ID NO: 13827 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGTTT
ttccccgttgcttgtttttg

SEQ ID NO: 13828 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
tagggaagcctttccccgtt

SEQ ID NO: 13829 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTTGCTT
taaatagggaagcctttccc

SEQ ID NO: 13830 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGTTT
caactttctacatatggcta

SEQ ID NO: 13831 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
tacaaggtgtaaggaaggga

SEQ ID NO: 13832 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGTTT
agagtttcttctagggtttt

SEQ ID NO: 13833 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGTTT
atattgcctagagtttcttc

SEQ ID NO: 13834 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGTTT
atgtcctgaatgatattgcc

SEQ ID NO: 13835 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
gcttttgttgccattgcttt

SEQ ID NO: 13836 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
tctgttttggcttttgttgc

SEQ ID NO: 13837 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
attagatcccatttgtctgt

SEQ ID NO: 13838 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGTTT
agtttaattagatcccattt

SEQ ID NO: 13839 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
cttttgctttgcagaagctc

SEQ ID NO: 13840 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
ttcactctgatgatagtttc

SEQ ID NO: 13841 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
ggttgcctgttcactctgat

SEQ ID NO: 13842 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
gtaaatttgtttaagttctt

SEQ ID NO: 13843 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tgtttgtttttttcttgtaa

SEQ ID NO: 13844 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
gcccactttttgatggagtt

SEQ ID NO: 13845 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
ctttgcccactttttgatgg

SEQ ID NO: 13846 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
tatctcattgtggttttgat

SEQ ID NO: 13847 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
gaggtggtatctcattgtgg

SEQ ID NO: 13848 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
ggcatgaggtggtatctcat

SEQ ID NO: 13849 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
tctgttgtttcctgactttt

SEQ ID NO: 13850 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
tccacatcctctccaacatc

SEQ ID NO: 13851 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
ggtcaaatggtatttctagt

SEQ ID NO: 13852 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGTTT
ttgctgggtcaaatggtatt

SEQ ID NO: 13853 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
ccttgagtatatacccagta

SEQ ID NO: 13854 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
atgcatgtgtctttatagta

SEQ ID NO: 13855 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
ttttgctgagaatgatggtt

SEQ ID NO: 13856 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGTTT
tgtgatattttgctgagaat

SEQ ID NO: 13857 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
atgagtgagaacatgcagag

SEQ ID NO: 13858 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
cacttatgagtgagaacatg

SEQ ID NO: 13859 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGTTT
cataggtatacatgtaccat

SEQ ID NO: 13860 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGTTT
agggtacatgtgcaaaacat

SEQ ID NO: 13861 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
atagaaatgtatattatcat

SEQ ID NO: 13862 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGTTT
tagaattaaaaaggtagtca

SEQ ID NO: 13863 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
gataatgttgacatccaata

SEQ ID NO: 13864 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
tgtaatcaattggaaagtcc

SEQ ID NO: 13865 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGCTT
ctagcccccctttgtaagat

SEQ ID NO: 13866 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAAGATT
gaagcttctagccccccttt

SEQ ID NO: 13867 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGCTT
cagagaacaaagggagcaac

SEQ ID NO: 13868 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGATT
tgaaaataaattcttaatta

SEQ ID NO: 13869 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGCTT
taagaaaattcaatataatg

SEQ ID NO: 13870 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGTTT
agggaagtctggttaccatt

SEQ ID NO: 13871 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
attaatgaacagtaaaggat

SEQ ID NO: 13872 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
agttttctcctcagtttttc

SEQ ID NO: 13873 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGTTT
ttcaaagttggagttttctc

SEQ ID NO: 13874 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGTTT
tttgattttctcttcaaagt

SEQ ID NO: 13875 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
ggggaaaacaaaatctatta

SEQ ID NO: 13876 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
gaattaattcataatctcct

SEQ ID NO: 13877 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGTTT
taggaaaacaaaacacccac

SEQ ID NO: 13878 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGTTT
acttacagaattccttccac

SEQ ID NO: 13879 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
actatgtaatacagcctcaa

SEQ ID NO: 13880 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGTTT
gactactcttataatgatga

SEQ ID NO: 13881 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGTTT
cattaactctcatcttatca

SEQ ID NO: 13882 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGATT
atgagttcaagttataaaaa

SEQ ID NO: 13883 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
ctctaatgatttcatgtgaa

SEQ ID NO: 13884 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
ataagtacttttttcacctc

SEQ ID NO: 13885 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGTTT
ctaataaccaaccctatttt

SEQ ID NO: 13886 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
tttaacttcaataatttgat

SEQ ID NO: 13887 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGCTT
cacaatgcaatgttgccact

SEQ ID NO: 13888 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGATT
cagttatgattgaaatgcct

SEQ ID NO: 13889 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGTTT
agcacagttatgattgaaat

SEQ ID NO: 13890 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
gtaacaggataccagcacag

SEQ ID NO: 13891 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
gcccctagaaaggatggata

SEQ ID NO: 13892 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
taatctaccgtccccttttc

SEQ ID NO: 13893 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGATT
caaaggacacaaaacagcca

SEQ ID NO: 13894 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGCTT
tccctaattctttgtgttcc

SEQ ID NO: 13895 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
ggatttcttttatccctttt

SEQ ID NO: 13896 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCGGATT
atttctttagggtcagtaac

SEQ ID NO: 13897 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ttcatgtatcatcttcctga

SEQ ID NO: 13898 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGATT
attgtgttcatgtatcatct

SEQ ID NO: 13899 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
tgactttttgtgtgtgtgtg

SEQ ID NO: 13900 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
attattgtattcttcaattc

SEQ ID NO: 13901 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGAGTTT
gtctgctattgaatcctcta

SEQ ID NO: 13902 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
cttggtttgttgattctttc

SEQ ID NO: 13903 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGATT
gggttgtttttttcttggtt

SEQ ID NO: 13904 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGTTT
tttgatggggttgttttttt

SEQ ID NO: 13905 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
ctttacccagtttttgatgg

SEQ ID NO: 13906 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGTTT
gtgtctgttcatatccttta

SEQ ID NO: 13907 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
gtgatgatgagcattttttc

SEQ ID NO: 13908 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
gagatggtatctcattgcgg

SEQ ID NO: 13909 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCGGTTT
ggtatgagatggtatctcat

SEQ ID NO: 13910 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
tccacatcctctccagcacc

SEQ ID NO: 13911 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGTTT
cggacttccacagtggttga

SEQ ID NO: 13912 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
gtgcatgcgtctttatagca

SEQ ID NO: 13913 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
cagtctatcattgttggaca

SEQ ID NO: 13914 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
gtttgctgagaatgatggtt

SEQ ID NO: 13915 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGTTT
tgcgatagtttgctgagaat

SEQ ID NO: 13916 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
tgtttggtttttttccttgc

SEQ ID NO: 13917 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
atgagtgagaaagtgcagtg

SEQ ID NO: 13918 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
cacctatgagtgagaaagtg

SEQ ID NO: 13919 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
tttttattttttattatact

SEQ ID NO: 13920 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGGGTTT
ttttttggtgtccatctttt

SEQ ID NO: 13921 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
tacacccctttctgtcttct

SEQ ID NO: 13922 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
tttgtcctatttgggattct

SEQ ID NO: 13923 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
cttctttagatttgtcctat

SEQ ID NO: 13924 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
ccatgcccagccgagacttc

SEQ ID NO: 13925 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
ccgctcagcccctcaaagtg

SEQ ID NO: 13926 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
tttgtaatttttggtagaga

SEQ ID NO: 13927 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGATT
aggcacccaccaccacaccc

SEQ ID NO: 13928 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctcagcctcccgagtag

SEQ ID NO: 13929 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGTTT
tctttcttttttttccgaga

SEQ ID NO: 13930 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
tgacaattcagtttttttct

SEQ ID NO: 13931 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
agctcttttggacatgacaa

SEQ ID NO: 13932 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
tttcactttatttgctcttt

SEQ ID NO: 13933 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGTTT
caggtatattattcttggtc

SEQ ID NO: 13934 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGTTT
atccttccttaattttaaag

SEQ ID NO: 13935 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
ctcagcatttgcttgtatga

SEQ ID NO: 13936 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
tggtgatgaactccctcagc

SEQ ID NO: 13937 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTCGTTT
tgtgttgctctttaccatgc

SEQ ID NO: 13938 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGCTT
tgctcttgtgttgctcttta

SEQ ID NO: 13939 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGCTT
tttacctttactagtgagat

SEQ ID NO: 13940 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGATT
ccatgtatttacctttacta

SEQ ID NO: 13941 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
aacttttatattagaattat

SEQ ID NO: 13942 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
acaatttacatctttttata

SEQ ID NO: 13943 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTGGATT
tttttatttctgtattttta

SEQ ID NO: 13944 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
tgatattttattgtgatatg

SEQ ID NO: 13945 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
tctctcttaactgtcttctt

SEQ ID NO: 13946 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
attgcctttttgttaaattt

SEQ ID NO: 13947 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGTTT
cattgtaggtcttttgattg

SEQ ID NO: 13948 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
ctatgcagccattgtaggtc

SEQ ID NO: 13949 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
ggagacagcatataactgga

SEQ ID NO: 13950 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
tttatcaattaactttcaaa

SEQ ID NO: 13951 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGATT
acatctgtagattcagccaa

SEQ ID NO: 13952 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
gtgtctgtgggttttacatc

SEQ ID NO: 13953 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGTTT
acagggtgtcctctgtgtct

SEQ ID NO: 13954 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGTTT
tgacctactttgtctcttgt

SEQ ID NO: 13955 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
acgtatttacatgctttgat

SEQ ID NO: 13956 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGCTT
aatgattgctttacgtattt

SEQ ID NO: 13957 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGCTT
atcccttcagatctgtcaat

SEQ ID NO: 13958 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
gtttatcccttcagatctgt

SEQ ID NO: 13959 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGTTT
cctactgttatggtgttgct

SEQ ID NO: 13960 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
gttcaaatccacagtttgtt

SEQ ID NO: 13961 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
tagcgttgttcaaatccaca

SEQ ID NO: 13962 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGTTT
tctatagcgttgttcaaatc

SEQ ID NO: 13963 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGTTT
gctgttgggtagcatattct

SEQ ID NO: 13964 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGATT
gtggtcataaaagatatctg

SEQ ID NO: 13965 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
ttttccttctattactgact

SEQ ID NO: 13966 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
ttccacatatttgtgaattt

SEQ ID NO: 13967 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
ccattgctttttcaagagag

SEQ ID NO: 13968 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
ttgattttttttctttgacc

SEQ ID NO: 13969 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
aagatacttttaaattttcc

SEQ ID NO: 13970 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
gaaattgtgctttcattttt

SEQ ID NO: 13971 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tttggaaattgtgctttcat

SEQ ID NO: 13972 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGCTT
catctcataaattttggaaa

SEQ ID NO: 13973 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGCTT
tcaataagatttgcttttat

SEQ ID NO: 13974 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
tagacatgtatctcaataag

SEQ ID NO: 13975 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
taatgtagacatgtatctca

SEQ ID NO: 13976 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
ttcctagacatgtaaatcta

SEQ ID NO: 13977 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
ttccttttgctgatgttggg

SEQ ID NO: 13978 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGCTT
tttccttccttttgctgatg

SEQ ID NO: 13979 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
ttagttttgttgactttttc

SEQ ID NO: 13980 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
atctttcgaaaaaaccaatt

SEQ ID NO: 13981 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGATT
tttttcttagttatgcttgc

SEQ ID NO: 13982 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGCTT
tcctctatcttttttcttag

SEQ ID NO: 13983 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGTTT
gtaaattctcctctttcatt

SEQ ID NO: 13984 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGATT
tattcagttattctatttcc

SEQ ID NO: 13985 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
attaatgttgtttcttcttt

SEQ ID NO: 13986 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
gagagtttgagaagaattaa

SEQ ID NO: 13987 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGTTT
tttcctcttcaaagttttaa

SEQ ID NO: 13988 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
tcgaagtgttctttcctctt

SEQ ID NO: 13989 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGCTT
cttttcttacagtgtctttg

SEQ ID NO: 13990 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
gaactgatccatgtgtatgt

SEQ ID NO: 13991 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
atgagtttttctactggatt

SEQ ID NO: 13992 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGATT
tggtgtgcatgagtttttct

SEQ ID NO: 13993 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
ttttctgtcctctggtgtgc

SEQ ID NO: 13994 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
ccttgggaagtagctgcaaa

SEQ ID NO: 13995 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
gttgggttctatatgtgtgc

SEQ ID NO: 13996 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
gaaaaccaaggcaattatga

SEQ ID NO: 13997 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGCTT
tgtacttgagagaaaactcc

SEQ ID NO: 13998 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATCGTTT
tcaggcagttcaaaaccccc

SEQ ID NO: 13999 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGCTT
gatggtctgatcccaggaat

SEQ ID NO: 14000 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
ggctggaaaacgtgtagcct

SEQ ID NO: 14001 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
ggtttattcttcatttgcta

SEQ ID NO: 14002 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGTTT
ttcctcttgtttaggctgaa

SEQ ID NO: 14003 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
ggcgtggggaatgttattcc

SEQ ID NO: 14004 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
aaaaaagaaagattgtagag

SEQ ID NO: 14005 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGATT
aaaaaaaaaaaaaaaaaaaa

SEQ ID NO: 14006 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCGAGATT
gaggcggagcttgcagtgag

SEQ ID NO: 14007 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGAGCTT
aatggcatgaacccgggagg

SEQ ID NO: 14008 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGATT
accttccacatcttttaaaa

SEQ ID NO: 14009 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGATT
tataaatatctgttagatct

SEQ ID NO: 14010 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGATT
tctatcctggagagtgtttc

SEQ ID NO: 14011 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGTTT
aacatgtgatctatcctgga

SEQ ID NO: 14012 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGTTT
atcttcttaaatttgttaaa

SEQ ID NO: 14013 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
atgaacagaaaacatactcg

SEQ ID NO: 14014 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGTTT
caaggttattcttattgact

SEQ ID NO: 14015 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
ccattgcctgttcaggagca

SEQ ID NO: 14016 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
gtcattgatcccaaaatatt

SEQ ID NO: 14017 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
attccatactatttgttatc

SEQ ID NO: 14018 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGCTT
attactataaatttttctct

SEQ ID NO: 14019 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGATT
tgtaatattaggttgtttat

SEQ ID NO: 14020 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
atctctaagatgtaatatta

SEQ ID NO: 14021 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
ttgttattttcttccttctg

SEQ ID NO: 14022 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
aaacaactttttagtatttg

SEQ ID NO: 14023 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
caaaaaaacaactttttagt

SEQ ID NO: 14024 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTCGATT
ggttagtctagttaaaggtt

SEQ ID NO: 14025 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
ttcccttggttagtctagtt

SEQ ID NO: 14026 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
ctcccttctttcatttcaga

SEQ ID NO: 14027 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
tggttgttcacattaatagt

SEQ ID NO: 14028 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
ggtgtatggttgttcacatt

SEQ ID NO: 14029 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
cttggtaggttgcatgtttc

SEQ ID NO: 14030 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGTTT
tgatttagtcttggtaggtt

SEQ ID NO: 14031 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
gtttgttcagatgtaatatt

SEQ ID NO: 14032 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGTTT
atctattttctttatccagt

SEQ ID NO: 14033 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGTTT
cttttctggtagcatactct

SEQ ID NO: 14034 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCAGTTT
gttcatcaagaatattggcc

SEQ ID NO: 14035 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
gttttaaatgtgctagggaa

SEQ ID NO: 14036 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
tcccaagtaatcatggtgaa

SEQ ID NO: 14037 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGTTT
tatcacatttattgatttat

SEQ ID NO: 14038 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
ttaatgtagcatatcacatt

SEQ ID NO: 14039 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
ctgcatctagtaagatgatc

SEQ ID NO: 14040 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
aacatatgctggattttatc

SEQ ID NO: 14041 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGATT
agattttattatgaacatat

SEQ ID NO: 14042 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGATT
ttccttccatatctgctttg

SEQ ID NO: 14043 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGCTT
ttaaggtacattccttccat

SEQ ID NO: 14044 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGCTT
ttagccgtgggcttgtcata

SEQ ID NO: 14045 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGCTT
gtttttgcataatgttagcc

SEQ ID NO: 14046 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
agaagaaaagctcccaactt

SEQ ID NO: 14047 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGATT
ttcctgcctaattgctatgg

SEQ ID NO: 14048 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGCTT
caaacagagataattttatt

SEQ ID NO: 14049 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGTTT
acagttctcagtagagtgtt

SEQ ID NO: 14050 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGTTT
caactttactgaatttatgt

SEQ ID NO: 14051 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGATT
aaatgctactgatttttcta

SEQ ID NO: 14052 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGATT
ttgttaatgtatagaaatgc

SEQ ID NO: 14053 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGATT
ttattttgatgctgttttaa

SEQ ID NO: 14054 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
attttatttatttattttga

SEQ ID NO: 14055 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
tcagtttttttaaatcaact

SEQ ID NO: 14056 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGTTT
tacaatttatttgtgtcttc

SEQ ID NO: 14057 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
gatagggattgcattgaatc

SEQ ID NO: 14058 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGATT
aactgacattagaattttga

SEQ ID NO: 14059 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
ttttttattttattcaaatg

SEQ ID NO: 14060 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGCTT
agctttgttctttttgctca

SEQ ID NO: 14061 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGATT
ctctagctttgttctttttg

SEQ ID NO: 14062 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGCTT
aaatgacagagtattgcacc

SEQ ID NO: 14063 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGCTT
atctgtgtttatgccaatag

SEQ ID NO: 14064 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
ttttccattagccaatatat

SEQ ID NO: 14065 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGCTT
ataaataattgggtttattt

SEQ ID NO: 14066 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGTTT
aatcaattgactataaataa

SEQ ID NO: 14067 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
gaagagatcgtcctttcccc

SEQ ID NO: 14068 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
attcttttgcataaggaata

SEQ ID NO: 14069 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
atatttaagtcttttacttg

SEQ ID NO: 14070 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGTTT
ttcttatatttaagtctttt

SEQ ID NO: 14071 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
atgttttcttctagtagctt

SEQ ID NO: 14072 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGCTT
tttcttttatgttttcttct

SEQ ID NO: 14073 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
aatgtcatacagcttttctt

SEQ ID NO: 14074 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGCTT
ccttgcccagataaatgtca

SEQ ID NO: 14075 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGCTT
ctcttattgtcttttgttac

SEQ ID NO: 14076 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
cgtttgctgtaaagaacatt

SEQ ID NO: 14077 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTCGTTT
ctctctccactctgttattg

SEQ ID NO: 14078 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
gatctctctctccactctgt

SEQ ID NO: 14079 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGTTT
tattagccctttatcagatg

SEQ ID NO: 14080 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGCTT
ttttctaggtgttgagttgc

SEQ ID NO: 14081 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
tattgattttctaggtgttg

SEQ ID NO: 14082 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
tgcccattctacaattggtt

SEQ ID NO: 14083 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGTTT
gattatttgcccattctaca

SEQ ID NO: 14084 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
cttcttttgagaaatgtctg

SEQ ID NO: 14085 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
gattttaatttgcatttttc

SEQ ID NO: 14086 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
aggtgtgaggtaatatttca

SEQ ID NO: 14087 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
ctgaattatatggtaattgt

SEQ ID NO: 14088 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAACGATT
gtgcaggtatacctttgaca

SEQ ID NO: 14089 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCGGTTT
tgggttagtgcaaaagtaat

SEQ ID NO: 14090 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
aatgacaaaatttgttcttt

SEQ ID NO: 14091 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
ttttgcttagcataacgtcc

SEQ ID NO: 14092 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
gtctttctgtacctggctaa

SEQ ID NO: 14093 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGTTT
agggtacatgtgcacaacgt

SEQ ID NO: 14094 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
ctatggcaaccacctttata

SEQ ID NO: 14095 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGATT
gaaaaatgtacatcctttga

SEQ ID NO: 14096 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
atttaagtctttaatccatc

SEQ ID NO: 14097 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
tcttccagggtttttatagt

SEQ ID NO: 14098 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
aggctgtcttccagggtttt

SEQ ID NO: 14099 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGTTT
gtattgcctaggctgtcttc

SEQ ID NO: 14100 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
ttaatttttgtttttgttgc

SEQ ID NO: 14101 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
attagatcccatttgttaat

SEQ ID NO: 14102 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
cttttgctgtgcagaagctc

SEQ ID NO: 14103 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
gactgtctgcttactctgtt

SEQ ID NO: 14104 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
tttctcccattctgtagact

SEQ ID NO: 14105 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
gtaaactcatttaagttcct

SEQ ID NO: 14106 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
ctttgcccactttttaatgg

SEQ ID NO: 14107 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
cattgagctttttttcatat

SEQ ID NO: 14108 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
gtgacattgagctttttttc

SEQ ID NO: 14109 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGCTT
ttctctaatggtcagtgaca

SEQ ID NO: 14110 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
gagatggtatctcattgtgg

SEQ ID NO: 14111 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
ggtgtgagatggtatctcat

SEQ ID NO: 14112 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGATT
ctttaggtatatacccagta

SEQ ID NO: 14113 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGATT
ctatcactgatggtcatttg

SEQ ID NO: 14114 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTCGTTT
tgtccctgcaaaggatatga

SEQ ID NO: 14115 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
atttggttttctgttcctgc

SEQ ID NO: 14116 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
ataagtgagaacatgtggta

SEQ ID NO: 14117 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGATT
catgtcataggggtttgttg

SEQ ID NO: 14118 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGGGTTT
tacataggtaaacatgtcat

SEQ ID NO: 14119 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
cttatttatggggtacaaaa

SEQ ID NO: 14120 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGCTT
tcatttttaattgacaaaaa

SEQ ID NO: 14121 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
ttgttctgtagtatgttttt

SEQ ID NO: 14122 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGTTT
atcagggatcttgttctgta

SEQ ID NO: 14123 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
tcatttaatgggctgttgca

SEQ ID NO: 14124 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGATT
ctgaatctcttctgatgatc

SEQ ID NO: 14125 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
aaaggttgttgaaatttgtc

SEQ ID NO: 14126 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
cctagcttttgttttctttt

SEQ ID NO: 14127 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tagcaacttctatacctagc

SEQ ID NO: 14128 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGCTT
aagttatagcaacttctata

SEQ ID NO: 14129 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGCTT
aattgcaattaaattgcaac

SEQ ID NO: 14130 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGTTT
gagaaaaggaggcagaacct

SEQ ID NO: 14131 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGATT
cattgaatacgatgttagct

SEQ ID NO: 14132 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
ctgatcttacaggaaagttt

SEQ ID NO: 14133 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
tcttattcctgatcttacag

SEQ ID NO: 14134 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGTTT
ttcagattgggatgtctttt

SEQ ID NO: 14135 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
atctgtaaacacttttttct

SEQ ID NO: 14136 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGATT
taaatttgtttattagttct

SEQ ID NO: 14137 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tatccttcaacatctagtaa

SEQ ID NO: 14138 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGATT
aaacgcaggtgatttttgta

SEQ ID NO: 14139 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGATT
ttgttagtgtatagaaacgc

SEQ ID NO: 14140 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
ctttcctaattttctcttca

SEQ ID NO: 14141 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
atttctttcctaattttctc

SEQ ID NO: 14142 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGATT
ttcttttgatgttatcataa

SEQ ID NO: 14143 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
aatttccttcatgaacattt

SEQ ID NO: 14144 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
tattttagtaaataatgcta

SEQ ID NO: 14145 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGCTT
attttgttcttttttcttaa

SEQ ID NO: 14146 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
ttccattttgttcttttttc

SEQ ID NO: 14147 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGATT
aataaataagaaatgagaaa

SEQ ID NO: 14148 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGTTT
ctggaggatcacttgtggcc

SEQ ID NO: 14149 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGCTT
tggggactgggtgcaatggc

SEQ ID NO: 14150 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGCTT
gaccatactattttaattgt

SEQ ID NO: 14151 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
cctgtttcattggcctatat

SEQ ID NO: 14152 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
gtttatttctgggctctcta

SEQ ID NO: 14153 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGTTT
tatgagttaactatttatgc

SEQ ID NO: 14154 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
tatttttttatatgtgaata

SEQ ID NO: 14155 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
gtttaaatgtttaatctatt

SEQ ID NO: 14156 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
agttttcaggtcttaggttt

SEQ ID NO: 14157 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGTTT
agttttacagttttcaggtc

SEQ ID NO: 14158 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGTTT
atgttttcttctacaagttt

SEQ ID NO: 14159 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
ttcctgctatgttttcttct

SEQ ID NO: 14160 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
agtatcatgaagctttcctg

SEQ ID NO: 14161 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGCTT
cattgtcaagaacagtatca

SEQ ID NO: 14162 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
tctcaattgtctatttttgc

SEQ ID NO: 14163 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
tcctttttttcccaaagctt

SEQ ID NO: 14164 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
tgaatgcttcctttttttcc

SEQ ID NO: 14165 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGCTT
ggttgctttttcaccctctt

SEQ ID NO: 14166 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGCTT
atattttctcccattctata

SEQ ID NO: 14167 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
cagtttttatttgaattttc

SEQ ID NO: 14168 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGTTT
ccactgcacctggccctcat

SEQ ID NO: 14169 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGTTT
ttttgtattttcagtagaga

SEQ ID NO: 14170 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctcagcttcccaagtag

SEQ ID NO: 14171 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGCTT
ggttcaagtgattctcctgc

SEQ ID NO: 14172 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
aacctccgactccctggttc

SEQ ID NO: 14173 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
ggccttgttgctgtttgttt

SEQ ID NO: 14174 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
gcccggccttgttgctgttt

SEQ ID NO: 14175 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
ccacgcccggccttgttgct

SEQ ID NO: 14176 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
gccaccacgcccggccttgt

SEQ ID NO: 14177 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
cgtctcggcctcccaaagtg

SEQ ID NO: 14178 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGGGTTT
ttttgtatttttagtagaga

SEQ ID NO: 14179 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGAGTTT
tgttgtttttttttttgaga

SEQ ID NO: 14180 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
tttttttttttttttttttt

SEQ ID NO: 14181 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
atctctttacggttttttgt

SEQ ID NO: 14182 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACGGTTT
ggtatgaaatgatatctctt

SEQ ID NO: 14183 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ttgatttgggtggtttttgt

SEQ ID NO: 14184 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tatcttttgatttgggtggt

SEQ ID NO: 14185 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGTTT
acctattatcttttgatttg

SEQ ID NO: 14186 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
ccttgccaacacctattatc

SEQ ID NO: 14187 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
aattttttcaggaactttca

SEQ ID NO: 14188 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
cattcatcaatagacattta

SEQ ID NO: 14189 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGTTT
tctttataaggctgaatagt

SEQ ID NO: 14190 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGATT
cattcaagttgctgcatatg

SEQ ID NO: 14191 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
ccattcttctctctgtttcc

SEQ ID NO: 14192 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
ctggcaatcaccattcttct

SEQ ID NO: 14193 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCTGCTT
ggaaacttaatatgagatct

SEQ ID NO: 14194 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
gctatgtagaagtacgtagt

SEQ ID NO: 14195 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGATT
tttattttctgaccttttct

SEQ ID NO: 14196 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGCTT
atttcatcttgcaatctaag

SEQ ID NO: 14197 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGATT
caccaaagtcaggaaacagt

SEQ ID NO: 14198 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGCTT
catccaattgactttaatct

SEQ ID NO: 14199 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGATT
ttttacatttataaagtgta

SEQ ID NO: 14200 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
caaatacagatgtttatttt

SEQ ID NO: 14201 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
atcctgacatttacaaatac

SEQ ID NO: 14202 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
taccaaaatgtcattagtgt

SEQ ID NO: 14203 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGCTT
agagaataataattttgggt

SEQ ID NO: 14204 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGTTT
gagataaaggagtctaattc

SEQ ID NO: 14205 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
ggtagaatctacagtattgc

SEQ ID NO: 14206 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
ttagagggtagaatctacag

SEQ ID NO: 14207 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGCTT
ggaccaaagactatttcaga

SEQ ID NO: 14208 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGCTT
agaattgctttttctagaga

SEQ ID NO: 14209 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGCTT
cattatggatctagctccag

SEQ ID NO: 14210 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
acatggcctgacagctaaaa

SEQ ID NO: 14211 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
agaatatggaagcaggagat

SEQ ID NO: 14212 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGATT
gtagggaagaatatggaagc

SEQ ID NO: 14213 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
agaccttttttaatagcagc

SEQ ID NO: 14214 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGTTT
tttggagaaatagtaaaaga

SEQ ID NO: 14215 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
gctttcggttttgaagaaat

SEQ ID NO: 14216 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCGGTTT
tcaggggggatagcaatgct

SEQ ID NO: 14217 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGCTT
cagcaattcaggggggatag

SEQ ID NO: 14218 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGCTT
atgaaatacgtgacaattga

SEQ ID NO: 14219 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
aaaaatagatgctgctatag

SEQ ID NO: 14220 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGATT
ctagtaaggatgccagtcac

SEQ ID NO: 14221 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGTTT
ttctggtagcccaggtgttt

SEQ ID NO: 14222 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGTTT
cttccagcttctggtagccc

SEQ ID NO: 14223 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
aaatatattttattgcctct

SEQ ID NO: 14224 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGGGCTT
gaacaggataatacaaacct

SEQ ID NO: 14225 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
ttaatcttcacatcaactgt

SEQ ID NO: 14226 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGTTT
agatatggttcctgagctca

SEQ ID NO: 14227 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGCTT
ttgtgtaatatatattgggt

SEQ ID NO: 14228 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
ttttttccaatgtttcctat

SEQ ID NO: 14229 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
atcaactattctgttttttc

SEQ ID NO: 14230 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
tttgagcaatatatcaacta

SEQ ID NO: 14231 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
ttatgatttaggttaaaccc

SEQ ID NO: 14232 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
aataataggttctggctaac

SEQ ID NO: 14233 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
tgactagtatacaattacaa

SEQ ID NO: 14234 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGATT
aagtttaatttgatatcaat

SEQ ID NO: 14235 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
attttccaaaaaagataatg

SEQ ID NO: 14236 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGTTT
cctatgtttacctaggatag

SEQ ID NO: 14237 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
atgctatggcttcttaaatc

SEQ ID NO: 14238 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGCTT
atgttaaacctcaacaatgc

SEQ ID NO: 14239 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGATT
catgttgaataaattgttaa

SEQ ID NO: 14240 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGATT
ttaagccctttgtagttatt

SEQ ID NO: 14241 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
caatatgagcacaaatatgc

SEQ ID NO: 14242 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
agttccatgctaagaaactt

SEQ ID NO: 14243 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
tacagtttaaaacaccttgg

SEQ ID NO: 14244 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGTTT
tgtatagcttttactgtttt

SEQ ID NO: 14245 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
taattttaatgtatagcttt

SEQ ID NO: 14246 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGCTT
aaaataaaataattttaatg

SEQ ID NO: 14247 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGCGCTT
ttactaaatgctcagtaaat

SEQ ID NO: 14248 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
attaccttaccttcttgaga

SEQ ID NO: 14249 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGATT
gtacagcagttggagataga

SEQ ID NO: 14250 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
aaaagcttcttagtttattt

SEQ ID NO: 14251 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
aactttatttttaaaagctt

SEQ ID NO: 14252 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
tagcactaaactttattttt

SEQ ID NO: 14253 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
gtggattctgttaatgtaag

SEQ ID NO: 14254 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGATT
acgattattatgtatgcagc

SEQ ID NO: 14255 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGACGATT
aaaggcaacttttaagggat

SEQ ID NO: 14256 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGCTT
gtttatggctattttagaat

SEQ ID NO: 14257 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
gtaacattaaacagacaaaa

SEQ ID NO: 14258 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAAGATT
ttagaaataattaactggga

SEQ ID NO: 14259 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
ccctttaaaaaatggagaaa

SEQ ID NO: 14260 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGCTT
aaaatgaacgtttttgaact

SEQ ID NO: 14261 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAACGTTT
tcaaatattgcttcaaaaat

SEQ ID NO: 14262 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
cccatcttgcaccattcaaa

SEQ ID NO: 14263 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGCTT
tggcaggcgcctgtaatcct

SEQ ID NO: 14264 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
aaattgaagataaaatactg

SEQ ID NO: 14265 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGCTT
ttgtaagtgtcccatttcat

SEQ ID NO: 14266 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
tgtcggacttggttacctat

SEQ ID NO: 14267 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
gtcaagttccaaatcgttcc

SEQ ID NO: 14268 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACGGTTT
tattaacaccacagatgggt

SEQ ID NO: 14269 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
attcagcatcatgggagtaa

SEQ ID NO: 14270 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGCTT
taacatcttactaatcctaa

SEQ ID NO: 14271 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCGGCTT
tgatgtcttagatatttaag

SEQ ID NO: 14272 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGTTT
taataaacatgagtcggctg

SEQ ID NO: 14273 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGCTT
agagttcatgtcttattttg

SEQ ID NO: 14274 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
ttaccttatcaataacaggt

SEQ ID NO: 14275 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
acaagtttaccttatcaata

SEQ ID NO: 14276 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
ttccagagtgtacagatttt

SEQ ID NO: 14277 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGATT
tttcttttttttccagagtg

SEQ ID NO: 14278 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
tataaatatatatttttcat

SEQ ID NO: 14279 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
ccacctacctgatatacacc

SEQ ID NO: 14280 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
tctaaaggatttaaaccatt

SEQ ID NO: 14281 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
tcgtagaaccagccaaatct

SEQ ID NO: 14282 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAACGATT
gagtaataataataaattta

SEQ ID NO: 14283 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGCTT
agcactatatatatttagtc

SEQ ID NO: 14284 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
gctgaaaagcagaaataaag

SEQ ID NO: 14285 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGATT
taagatgacaggtaggtttt

SEQ ID NO: 14286 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAGGTTT
gctgaagtgtaagatgacag

SEQ ID NO: 14287 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCTGCTT
tattttaaagcatcttgaga

SEQ ID NO: 14288 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGATT
gcaaaccttctccctagatg

SEQ ID NO: 14289 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
aagcctaaaaatatttataa

SEQ ID NO: 14290 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
cttggaacacagccatacca

SEQ ID NO: 14291 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCAGTTT
tgttcttggaacacagccat

SEQ ID NO: 14292 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGTTT
ccaaaggtcaacaaacccca

SEQ ID NO: 14293 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ccggaaagacagcacaacca

SEQ ID NO: 14294 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGCTT
cacagaatagattgtgcaag

SEQ ID NO: 14295 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
cacatggtagggaggcacag

SEQ ID NO: 14296 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGATT
tgcctgtctttctcagagac

SEQ ID NO: 14297 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGCTT
taggctctttagctttccca

SEQ ID NO: 14298 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
ttgtttgagtccttaggctc

SEQ ID NO: 14299 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
tttgaggcatattgtagtca

SEQ ID NO: 14300 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGCTT
tgcatttgaggcatattgta

SEQ ID NO: 14301 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
aggtgaattggatgcaggag

SEQ ID NO: 14302 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
taagccagcccactatttaa

SEQ ID NO: 14303 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
ccctacaaaaccacttcctt

SEQ ID NO: 14304 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
ctatctacaagttgaaaatt

SEQ ID NO: 14305 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGATT
ttccaagtataaaagaaaga

SEQ ID NO: 14306 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACGGTTT
attttaattatccagtgtat

SEQ ID NO: 14307 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGTTT
ccaggatggggataagaaac

SEQ ID NO: 14308 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATCGCTT
tagggaggctgaggcagaag

SEQ ID NO: 14309 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
cagcttactgatactttaag

SEQ ID NO: 14310 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
caatttaacacggagattag

SEQ ID NO: 14311 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGAGATT
cttctctgagcaatttaaca

SEQ ID NO: 14312 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
cattatattgtattttactt

SEQ ID NO: 14313 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCCGTTT
cctgccctgtcccgacccta

SEQ ID NO: 14314 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGCTT
tattttatgcctctgttctg

SEQ ID NO: 14315 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGATT
tactcctctaaaatttcttc

SEQ ID NO: 14316 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGATT
caactaccataacctagctt

SEQ ID NO: 14317 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGCTT
atgaataacaactaccataa

SEQ ID NO: 14318 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGTTT
tttgagaaaactaaagctca

SEQ ID NO: 14319 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
atatcaggtgttcaaataat

SEQ ID NO: 14320 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
acacacagtatttcagtgca

SEQ ID NO: 14321 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCTGTTT
tctgtttacataaatacata

SEQ ID NO: 14322 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
atgtagaaattatgagttgt

SEQ ID NO: 14323 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
atgggtatgtagaaattatg

SEQ ID NO: 14324 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGTTT
ataatgttcttattttttaa

SEQ ID NO: 14325 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGATT
taagacctctaagagcctta

SEQ ID NO: 14326 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGCTT
attaaatcccttcggacact

SEQ ID NO: 14327 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
ttaatgaaaatgttattttt

SEQ ID NO: 14328 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGCTT
tcagaattgactttttcctt

SEQ ID NO: 14329 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGTTT
ttcctgttgagttgctttta

SEQ ID NO: 14330 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
ccatcttattgttcctgttg

SEQ ID NO: 14331 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
caaatagaataaacaactta

SEQ ID NO: 14332 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
caaaagtgtgaaaagcatat

SEQ ID NO: 14333 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
ttaataaggaattacaaagc

SEQ ID NO: 14334 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
accattgttctaattaaatt

SEQ ID NO: 14335 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGTTT
atcacacacttcattttgac

SEQ ID NO: 14336 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGCTT
tgaataccacacttttaggg

SEQ ID NO: 14337 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGCTT
ttgagtgaataccacacttt

SEQ ID NO: 14338 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGATT
taataagatttatactaaga

SEQ ID NO: 14339 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
agtcttcaaaatgtttttta

SEQ ID NO: 14340 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ctcaaaatcatgagtcttca

SEQ ID NO: 14341 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
tcattctctcttcagtacaa

SEQ ID NO: 14342 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
tgaagctcttattatatcta

SEQ ID NO: 14343 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
tgctttgtaactaaaatgtg

SEQ ID NO: 14344 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
tctaaggtcatggaggagct

SEQ ID NO: 14345 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGTTT
aaacacttcccgcttcatca

SEQ ID NO: 14346 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCCGCTT
gatgagcactttaaaacact

SEQ ID NO: 14347 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTAGCTT
gtaatttattctgctaaata

SEQ ID NO: 14348 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
aaaacattaaaaaaaaaatt

SEQ ID NO: 14349 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
attgggaattaagttccaac

SEQ ID NO: 14350 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
ggtgttcactgagagccaaa

SEQ ID NO: 14351 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGCTT
tgtcataaaactcacttaac

SEQ ID NO: 14352 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGTTT
gtatatttgtatatatacgt

SEQ ID NO: 14353 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGATT
ttctgggttatttgaaactt

SEQ ID NO: 14354 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGCTT
aatggacttgtctgatttct

SEQ ID NO: 14355 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGATT
gctactcagagaatggactt

SEQ ID NO: 14356 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
acagatgattctgttgtata

SEQ ID NO: 14357 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
atcattgtaacaagccctac

SEQ ID NO: 14358 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCTGATT
ggacacagatttgggggagt

SEQ ID NO: 14359 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
cagagatgcaaattttggga

SEQ ID NO: 14360 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
ttttatttgaaaatttaaag

SEQ ID NO: 14361 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
tatggctgtttaataatgga

SEQ ID NO: 14362 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCTGTTT
tattttaaattaagagatat

SEQ ID NO: 14363 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGTTT
catcattcagtgtaagaaat

SEQ ID NO: 14364 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
agaagaaattatagaaggaa

SEQ ID NO: 14365 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
aatgggtatttttgtaatat

SEQ ID NO: 14366 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
aattctaacttcggatatag

SEQ ID NO: 14367 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGTTT
tacaccttatatgtgttatc

SEQ ID NO: 14368 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTCGTTT
tcaaaaaaaataataataat

SEQ ID NO: 14369 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
tcgagatcgtgccactgcac

SEQ ID NO: 14370 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGTTT
atcgcttgaacccggtaggc

SEQ ID NO: 14371 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATCGCTT
tcaggaggctgaggcagaag

SEQ ID NO: 14372 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGTTT
caggtggatcacctgaggtc

SEQ ID NO: 14373 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
tattcaaagcttcataaact

SEQ ID NO: 14374 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
tcaatttctcaactgttatt

SEQ ID NO: 14375 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGATT
tgaattcatacagcatcata

SEQ ID NO: 14376 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCGAGCTT
ttaaccaagggtttgcatta

SEQ ID NO: 14377 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGTTT
aagtgctttaaaatttaacc

SEQ ID NO: 14378 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGCTT
gcaaatttgtatatgccaat

SEQ ID NO: 14379 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
atcagtcatagtttttagag

SEQ ID NO: 14380 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGATT
ctataatcagtcatagtttt

SEQ ID NO: 14381 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
agaaacatcctataatcagt

SEQ ID NO: 14382 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
gattttcagaaacctaacct

SEQ ID NO: 14383 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGATT
ctttatcttttactaattct

SEQ ID NO: 14384 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGCTT
acatattttgtattaattaa

SEQ ID NO: 14385 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
gtagaaatatttttacaggc

SEQ ID NO: 14386 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGCTT
aacgaagtagaaatattttt

SEQ ID NO: 14387 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
tggaaaatacataataattc

SEQ ID NO: 14388 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
cacagattaaagagaggaaa

SEQ ID NO: 14389 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
agatgataaaagggcagaga

SEQ ID NO: 14390 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
gagatgtgattttttaaaaa

SEQ ID NO: 14391 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGATT
ttatgttttctgcaaaggag

SEQ ID NO: 14392 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
aacatttataattgagtttt

SEQ ID NO: 14393 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
tgacattgtaacatttataa

SEQ ID NO: 14394 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
gcttcatatattttcaggct

SEQ ID NO: 14395 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGCTT
attatcatattttaattttg

SEQ ID NO: 14396 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
acttttgagtacattttaaa

SEQ ID NO: 14397 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGATT
ttcaccaatgcctggtgttg

SEQ ID NO: 14398 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
cacttacatcttcattctgg

SEQ ID NO: 14399 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
tattgaaaggaaaaagacca

SEQ ID NO: 14400 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGCTT
gaaacttgaatattatttcc

SEQ ID NO: 14401 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
aatcatgaagcttaagttgt

SEQ ID NO: 14402 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGCTT
tgttttttttaaatgaatca

SEQ ID NO: 14403 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
tagcattagaattgtatttt

SEQ ID NO: 14404 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
tcagctggcccatgtcaata

SEQ ID NO: 14405 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGATT
tcagagatcatgagtctttt

SEQ ID NO: 14406 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
aaaggggagtgtaggatgtg

SEQ ID NO: 14407 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGCTT
agaacagtgatttttagagc

SEQ ID NO: 14408 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
cattaatggagagaatagaa

SEQ ID NO: 14409 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
attttatccaacagggttaa

SEQ ID NO: 14410 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
ttttcttcaatattgatacc

SEQ ID NO: 14411 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGATT
agtttcggtttagatggctt

SEQ ID NO: 14412 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGCTT
attgccatagtttcggttta

SEQ ID NO: 14413 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCGGTTT
gactgagtcattgccatagt

SEQ ID NO: 14414 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
ttcaaggactgagtcattgc

SEQ ID NO: 14415 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTCGTTT
acaccagttctagaaacagg

SEQ ID NO: 14416 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGCTT
cctgtacaccagttctagaa

SEQ ID NO: 14417 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
aagctgggtacagttttaaa

SEQ ID NO: 14418 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGTTT
ttaccaatgatgaagctggg

SEQ ID NO: 14419 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
aaccctgtgagattatgata

SEQ ID NO: 14420 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGATT
tttaattttcaaacaaccct

SEQ ID NO: 14421 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
attgtgtttcagaatcttct

SEQ ID NO: 14422 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
tctcatttagcttatactta

SEQ ID NO: 14423 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
aaaagaagtaatagctctca

SEQ ID NO: 14424 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGTGTTT
gtatagcaaacccccatgac

SEQ ID NO: 14425 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGATT
ttagacaggttgccaattaa

SEQ ID NO: 14426 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
ggaaagatatttcaagaagc

SEQ ID NO: 14427 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
agaggagattacaaaaaaat

SEQ ID NO: 14428 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGATT
tgtgactgagaatttcagag

SEQ ID NO: 14429 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGTTT
aatgtattcctagtaactaa

SEQ ID NO: 14430 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGCTT
aacaacctgcagggacccac

SEQ ID NO: 14431 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGCTT
gatgtcacagctgaggaaca

SEQ ID NO: 14432 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGATT
gaatgagtgtgtacacatat

SEQ ID NO: 14433 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
ggaaagtagcatgagtttca

SEQ ID NO: 14434 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
acttatgtgtggaaagtagc

SEQ ID NO: 14435 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGCTT
ggatgctggcagaagatatg

SEQ ID NO: 14436 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
atgctaataggttgatctga

SEQ ID NO: 14437 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
acagtcttcatgagtttgga

SEQ ID NO: 14438 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
ttgcctcatagacagtcttc

SEQ ID NO: 14439 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGTTT
atctagctagatataccact

SEQ ID NO: 14440 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGCTT
ctcattcttgtacacataca

SEQ ID NO: 14441 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
agttttaggataaaagtagg

SEQ ID NO: 14442 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGTTT
tataaaaagggaaaacagat

SEQ ID NO: 14443 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGCTT
agatactatgagaaagcaag

SEQ ID NO: 14444 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGCTT
tgcaatttcagaaacgtaaa

SEQ ID NO: 14445 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGCTT
agttctgtagcaaggagaac

SEQ ID NO: 14446 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
tgagtaactgtagagcttgg

SEQ ID NO: 14447 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGCTT
agaatacaaatgagtaactg

SEQ ID NO: 14448 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
aaagataaataagatccagg

SEQ ID NO: 14449 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGCTT
ggagtaatgttttgtaccct

SEQ ID NO: 14450 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
gagaattataattcttggag

SEQ ID NO: 14451 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGCTT
actaatttcaagttacaaca

SEQ ID NO: 14452 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
acaattagtcctagagtgta

SEQ ID NO: 14453 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGTTT
tagaacaaagagagaaggtt

SEQ ID NO: 14454 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGTTT
aagagaattttactggcaat

SEQ ID NO: 14455 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
gttttacctagaattaatcc

SEQ ID NO: 14456 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
aagataaaaatatcatggca

SEQ ID NO: 14457 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
atctgacacctaagtcaata

SEQ ID NO: 14458 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGCTT
ttgttgaacacagttggttt

SEQ ID NO: 14459 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGTTT
ctacaagattgttgaacaca

SEQ ID NO: 14460 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGATT
gaacatcaggaaaacctgct

SEQ ID NO: 14461 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGATT
aattttatttattctgaata

SEQ ID NO: 14462 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGTTT
gttgagggagtatcacagaa

SEQ ID NO: 14463 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGATT
ggaggagactgaagagaaat

SEQ ID NO: 14464 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
tcattcacacataaaatgaa

SEQ ID NO: 14465 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
accctaaaattcatgtcgtc

SEQ ID NO: 14466 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGGGTTT
gtttagaaaggtgtatttca

SEQ ID NO: 14467 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
gtttccactaattttctcaa

SEQ ID NO: 14468 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGTTT
tttcttttgaacttaatttc

SEQ ID NO: 14469 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
atctggatcttctaatcaag

SEQ ID NO: 14470 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
ttttaacttagaatacttga

SEQ ID NO: 14471 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
acataaaaatttaaagtcac

SEQ ID NO: 14472 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGTTT
atacataaaagatacgtaac

SEQ ID NO: 14473 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
atctagttatagtcatttat

SEQ ID NO: 14474 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGATT
tcaagaaataagccaggtga

SEQ ID NO: 14475 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGATT
tttctcaagaaataagccag

SEQ ID NO: 14476 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
caaactcttttttactgata

SEQ ID NO: 14477 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGTTT
tgcttgcatcacaattctaa

SEQ ID NO: 14478 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGCTT
acccttgcctcttgtgtaca

SEQ ID NO: 14479 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGCTT
aaactccttaaggtaaaggc

SEQ ID NO: 14480 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGCTT
tgcaatttgcgtatctcgtt

SEQ ID NO: 14481 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
ggatactggaccagaatcca

SEQ ID NO: 14482 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGATT
tccaatcaatcaccaaatcc

SEQ ID NO: 14483 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
gccgagtcagctcctcctcc

SEQ ID NO: 14484 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCCGTTT
ttcttttctagacaggtttt

SEQ ID NO: 14485 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
tactaagaattcttttctag

SEQ ID NO: 14486 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
cccttaatattgttgtttca

SEQ ID NO: 14487 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
tgaattctctcccttaatat

SEQ ID NO: 14488 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
taacaacaagaattggtatg

SEQ ID NO: 14489 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGTTT
acagacaagcaggaatttct

SEQ ID NO: 14490 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCTGCTT
atagtcaaatatttaataat

SEQ ID NO: 14491 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAAGTTT
ttaaggtaagttatagaatt

SEQ ID NO: 14492 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGATT
ttgctaaatgcagagttaag

SEQ ID NO: 14493 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGATT
aatgtaaagattcccaccat

SEQ ID NO: 14494 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
gcttggagatttttgtaatg

SEQ ID NO: 14495 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGATT
aagctctcatttgtagtgct

SEQ ID NO: 14496 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGCTT
aatcaagaagctctcatttg

SEQ ID NO: 14497 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGTTT
acaatacaccttgactgttt

SEQ ID NO: 14498 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGTTT
ctacaaacacaatacacctt

SEQ ID NO: 14499 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGCTT
aagtatagttttagcatgaa

SEQ ID NO: 14500 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
ttttgcagctaataaacaag

SEQ ID NO: 14501 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGCTT
atatcaaattgtttctcaaa

SEQ ID NO: 14502 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
attgaacattctgtatatca

SEQ ID NO: 14503 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
atctctcatttcatctactt

SEQ ID NO: 14504 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
tcttataaaactttttactc

SEQ ID NO: 14505 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
tgggcctcttatgttcatag

SEQ ID NO: 14506 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
ttaaattgattaaaattttt

SEQ ID NO: 14507 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
agttgctttaataaacttta

SEQ ID NO: 14508 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
cttttcttcagagtaattct

SEQ ID NO: 14509 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGTTT
cctcctgccttcatctaaaa

SEQ ID NO: 14510 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
caatacttgttaatgaatta

SEQ ID NO: 14511 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
gttgttttagaacatacaac

SEQ ID NO: 14512 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
tgtcaagaggattctagttt

SEQ ID NO: 14513 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGTTT
gtgcatcttgtcaagaggat

SEQ ID NO: 14514 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
ctaccaggtgcatcttgtca

SEQ ID NO: 14515 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
aattagacttcagaaacatg

SEQ ID NO: 14516 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
catagggggagagggaaaca

SEQ ID NO: 14517 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGTTT
caaagagcaagcattacaga

SEQ ID NO: 14518 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGATT
caaattatgactaactgctt

SEQ ID NO: 14519 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGCTT
taacctttcaaattatgact

SEQ ID NO: 14520 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
ctttttttttctttttcatc

SEQ ID NO: 14521 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
attgtataaatgaagctatg

SEQ ID NO: 14522 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
tttttgaccctaccctttta

SEQ ID NO: 14523 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
ggtatttttattttccctga

SEQ ID NO: 14524 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
cttatatgtgatcattgttt

SEQ ID NO: 14525 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
aattctttcttatatgtgat

SEQ ID NO: 14526 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
aataatgtttcccttcaatt

SEQ ID NO: 14527 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
tatttcctcaatcataagaa

SEQ ID NO: 14528 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
acttttctaattaggatttt

SEQ ID NO: 14529 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
aagtttactaacttttctaa

SEQ ID NO: 14530 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
atgaaacttcatttcagatt

SEQ ID NO: 14531 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
caatatttatgaaacttcat

SEQ ID NO: 14532 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCAGCTT
aaggtatgataacattgcta

SEQ ID NO: 14533 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
aatgtttgagagattctctg

SEQ ID NO: 14534 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGATT
tgggacccattaaaatgttt

SEQ ID NO: 14535 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ttactcactgggacccatta

SEQ ID NO: 14536 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
ttttttttttttttgagagc

SEQ ID NO: 14537 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGCTT
tttttttttttttttttttt

SEQ ID NO: 14538 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
gtctgtcttttgaagtggtc

SEQ ID NO: 14539 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGTTT
aattatattgatcatgctgt

SEQ ID NO: 14540 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
gttaagaaatggtgaaaaaa

SEQ ID NO: 14541 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
tgatgttaagaaatggtgaa

SEQ ID NO: 14542 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
gaaagataatgttaacaaat

SEQ ID NO: 14543 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
gccaaatcatcttcctttca

SEQ ID NO: 14544 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATCGCTT
tcaagaggctgaggcaggag

SEQ ID NO: 14545 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCCGTTT
tcctggctaacatggtgaaa

SEQ ID NO: 14546 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGATT
caaattagtaaattacataa

SEQ ID NO: 14547 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
tggttttatattgtgctgct

SEQ ID NO: 14548 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
gtctatgtggttttatattg

SEQ ID NO: 14549 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
gacatgactctttgggtcta

SEQ ID NO: 14550 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGCTT
ctttgtatttgaagacttca

SEQ ID NO: 14551 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
atcactttactaatgtattt

SEQ ID NO: 14552 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGCTT
tctcacatttgttgattcat

SEQ ID NO: 14553 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGATT
gttgttcatagtctcacatt

SEQ ID NO: 14554 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAACGATT
tttactgaagataaatgtta

SEQ ID NO: 14555 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGTTT
aaaagaattaaatccaagta

SEQ ID NO: 14556 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
gaatcaatgccagttcagag

SEQ ID NO: 14557 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
gtcagaatgaagaatcatga

SEQ ID NO: 14558 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGCTT
ccacatgaagactgagaagc

SEQ ID NO: 14559 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
gtgcttaaaaactggaaatg

SEQ ID NO: 14560 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGTGCTT
ttgttgatggattgaacatt

SEQ ID NO: 14561 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
tagagctgaagggatttgtt

SEQ ID NO: 14562 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGATT
atattttgaagttagagctg

SEQ ID NO: 14563 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGTTT
gggagcttagactagtatgg

SEQ ID NO: 14564 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGAGCTT
aaatccaggtgagaggtgat

SEQ ID NO: 14565 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGTTT
gcagaagctggaagatttct

SEQ ID NO: 14566 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGATT
gaatagcaatggcagaagct

SEQ ID NO: 14567 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGATT
atttgaagaacattataagg

SEQ ID NO: 14568 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGATT
agatcagagatgtagtagag

SEQ ID NO: 14569 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGATT
gaggcagaggttgcagtgag

SEQ ID NO: 14570 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
gagaataatgaaagatggga

SEQ ID NO: 14571 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGCGTTT
agaaagcctgcctataaagg

SEQ ID NO: 14572 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGATT
cacataaatatgctatcaat

SEQ ID NO: 14573 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
taaattcagtgaagcagcca

SEQ ID NO: 14574 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGCTT
aaacacattttccaatgaac

SEQ ID NO: 14575 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
gtgaatactctgagattatt

SEQ ID NO: 14576 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
aaaatacttttgtgaatact

SEQ ID NO: 14577 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
tgttataataagatataata

SEQ ID NO: 14578 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
gttgggcttatcaatcaact

SEQ ID NO: 14579 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGCTT
ctaggataactagaaagaag

SEQ ID NO: 14580 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGATT
ttaaatttgtattgatgcta

SEQ ID NO: 14581 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGATT
ctttaaaagtgtccatgtta

SEQ ID NO: 14582 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGTTT
attagtgctataagcaaatg

SEQ ID NO: 14583 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGCTT
acatccagtcaatataaatt

SEQ ID NO: 14584 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGATT
tcagcaaactacaaagagtg

SEQ ID NO: 14585 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
taacattcatgggttaagca

SEQ ID NO: 14586 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGTTT
cagtgtccaagattttctca

SEQ ID NO: 14587 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGATT
catcgacttgctttcagtgt

SEQ ID NO: 14588 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGCTT
tattttttgaaaaatcatcg

SEQ ID NO: 14589 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGCTT
tgctaatgacttatctagtc

SEQ ID NO: 14590 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGATT
cttctacttttcttattctt

SEQ ID NO: 14591 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
gctaagaggatcaaataaga

SEQ ID NO: 14592 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGCTT
cagtacctccttctactcct

SEQ ID NO: 14593 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
ctttacatttggccttagtc

SEQ ID NO: 14594 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
agatagggcccaagccctta

SEQ ID NO: 14595 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
taaagactttgagagaccct

SEQ ID NO: 14596 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGCTT
aacaaaactttagtatggtt

SEQ ID NO: 14597 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGTTT
aaacaaaaacaaaactttag

SEQ ID NO: 14598 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
tgtaaaacattccaagttta

SEQ ID NO: 14599 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGTTT
tctgttgtttgtaaaacatt

SEQ ID NO: 14600 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
ccccattggtcatcaccatc

SEQ ID NO: 14601 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGCTT
acctcactcttgagtcccag

SEQ ID NO: 14602 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGCTT
tgaggtgtttcatgcatgcc

SEQ ID NO: 14603 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGTTT
tttcttattctgaagctctg

SEQ ID NO: 14604 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
ttttctgcacatcctgtaaa

SEQ ID NO: 14605 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
ctctcaaaattcttcctttc

SEQ ID NO: 14606 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGTTT
ctactcactaactctcagaa

SEQ ID NO: 14607 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
gtcactagagctctctaagc

SEQ ID NO: 14608 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAAGCTT
gggcaagtcactagagctct

SEQ ID NO: 14609 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
ctgattcagctatagctgta

SEQ ID NO: 14610 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGATT
agtcagaagactccattcca

SEQ ID NO: 14611 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGTTT
gcattccttaattagtgttc

SEQ ID NO: 14612 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGTTT
tgaattccgatgagccagag

SEQ ID NO: 14613 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGATT
tggggtggtgaattcctttc

SEQ ID NO: 14614 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGCTT
gcatgagtctgattattaaa

SEQ ID NO: 14615 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGATT
tttcataatactttgcatga

SEQ ID NO: 14616 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
taaggttacttgacctcaat

SEQ ID NO: 14617 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
tgttagtataataaacataa

SEQ ID NO: 14618 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
gggtataggttgtcctcaaa

SEQ ID NO: 14619 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGCTT
ttttttgccaactatttgat

SEQ ID NO: 14620 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
ttaaaaaattttaactatca

SEQ ID NO: 14621 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
cattttgatttcaaaaccgt

SEQ ID NO: 14622 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
tgttggtatggtcattggca

SEQ ID NO: 14623 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
tttcttgacattataaataa

SEQ ID NO: 14624 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGCTT
tttgtttcagagtttgcatg

SEQ ID NO: 14625 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
attttcttcgatctttgttt

SEQ ID NO: 14626 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
catgtttaattttcttcgat

SEQ ID NO: 14627 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
ttattccatgtgtaagtctg

SEQ ID NO: 14628 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
gttgctgtatgtattttttg

SEQ ID NO: 14629 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
acaatatttgggaaatttga

SEQ ID NO: 14630 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
aattaactcttccattgata

SEQ ID NO: 14631 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGCTT
agaattgtgttgtagtaact

SEQ ID NO: 14632 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGCTT
ttattatttttagcacttgc

SEQ ID NO: 14633 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGATT
ctatcatattaatacaaatt

SEQ ID NO: 14634 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
caatctctaaaagtcaaacc

SEQ ID NO: 14635 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGCTT
tggtacccatcaagaatact

SEQ ID NO: 14636 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
ccagttataagaaagacatt

SEQ ID NO: 14637 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGATT
gaataatgcctctaggccaa

SEQ ID NO: 14638 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
gaattcaatcagtttaaata

SEQ ID NO: 14639 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGTTT
aactaatttagatgaattca

SEQ ID NO: 14640 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
ttatactttaaagcctattc

SEQ ID NO: 14641 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
atatattttaaaactcattc

SEQ ID NO: 14642 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGATT
aagtttatccaacatcgttt

SEQ ID NO: 14643 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATCGTTT
gtaattataagtttatccaa

SEQ ID NO: 14644 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
caaaatacatattagtaatt

SEQ ID NO: 14645 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGATT
tagtcttctaaatatggtac

SEQ ID NO: 14646 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGCTT
tttctatcagcaattcctct

SEQ ID NO: 14647 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGTGCTT
tattgtgtctaatagcaggg

SEQ ID NO: 14648 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
aaccaattattgatgtttga

SEQ ID NO: 14649 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
acagtgagaaaaccaattat

SEQ ID NO: 14650 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
cataaaacctgcatatgaaa

SEQ ID NO: 14651 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
atatacagtatggaaatagt

SEQ ID NO: 14652 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGCTT
gaactgtctatattgctaaa

SEQ ID NO: 14653 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
gaagcttatactgtagcaag

SEQ ID NO: 14654 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGCTT
ttctcttagaaatctgctaa

SEQ ID NO: 14655 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
gaaaactaaacaacagatga

SEQ ID NO: 14656 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
tacatggaaaactaaacaac

SEQ ID NO: 14657 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGCTT
gtgagtccaccttcttgatc

SEQ ID NO: 14658 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
gaatgctaattatggtacac

SEQ ID NO: 14659 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
taaatactattatacattta

SEQ ID NO: 14660 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTCGATT
cctctctctctttttctctc

SEQ ID NO: 14661 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
aagtttacaatcaagataag

SEQ ID NO: 14662 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGATT
acataagtttacaatcaaga

SEQ ID NO: 14663 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
ggagcatcttaaatagctac

SEQ ID NO: 14664 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGCTT
gggaaaaccatgaagaataa

SEQ ID NO: 14665 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGCTT
tcaagcagtatagtagaaaa

SEQ ID NO: 14666 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
atgaaataggcttacatcgt

SEQ ID NO: 14667 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGCTT
atcatccatgatagcatgaa

SEQ ID NO: 14668 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTAGATT
gatagtttcttcttttgagc

SEQ ID NO: 14669 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
tgtacagtgctgctgtgttt

SEQ ID NO: 14670 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
ctgtgttttgtacagtgctg

SEQ ID NO: 14671 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
agtaaggtttttgttgagtt

SEQ ID NO: 14672 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGTTT
catcaatcattctctttgag

SEQ ID NO: 14673 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
tttttttgttgtgtgaagca

SEQ ID NO: 14674 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
atacccatctcctccttttg

SEQ ID NO: 14675 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
cttttatacccatctcctcc

SEQ ID NO: 14676 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
cttattaacagataatggag

SEQ ID NO: 14677 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGCTT
tcttgcttattaacagataa

SEQ ID NO: 14678 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGCTT
aactaattttaaaatgtctt

SEQ ID NO: 14679 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
aaatttactattttactcct

SEQ ID NO: 14680 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGATT
tatgccacatagtaactatg

SEQ ID NO: 14681 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGATT
aggaaaaaaataaaggccct

SEQ ID NO: 14682 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGATT
aatctaaatcatgttaagaa

SEQ ID NO: 14683 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
agaaatttcatatcaaaaaa

SEQ ID NO: 14684 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
ttcctgaaattcctgagctt

SEQ ID NO: 14685 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGCTT
ccatttttttcctgaaattc

SEQ ID NO: 14686 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
gacaacagaagaaaatacag

SEQ ID NO: 14687 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
cctttttttaaaaaaagagc

SEQ ID NO: 14688 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGTTT
aaaataggaaaggaaaaaaa

SEQ ID NO: 14689 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGTTT
gttgaccttgtgatggaact

SEQ ID NO: 14690 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
ctgaatttctctggtggtgg

SEQ ID NO: 14691 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGTTT
gaagaggtctccgtgaaatc

SEQ ID NO: 14692 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGATT
ggatagaaagtgccctaggt

SEQ ID NO: 14693 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAAGTTT
atatcttatcatttagtcac

SEQ ID NO: 14694 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
ggccaactgttgttgctttt

SEQ ID NO: 14695 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGCTT
cttcttacatggccaactgt

SEQ ID NO: 14696 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
ttctcttcttttcattagaa

SEQ ID NO: 14697 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
gccactttacactcctagct

SEQ ID NO: 14698 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGCTT
gacttgacccactgtattcc

SEQ ID NO: 14699 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGCTT
aatagcaaaattgtttaaat

SEQ ID NO: 14700 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
cataaatagcaaaattgttt

SEQ ID NO: 14701 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
taagctggcataaatagcaa

SEQ ID NO: 14702 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
tgcgtatctacactttgcct

SEQ ID NO: 14703 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGAAGCTT
aaaattatagataatattta

SEQ ID NO: 14704 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
actttgtgtttgtcattctt

SEQ ID NO: 14705 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
gcttactttgtgtttgtcat

SEQ ID NO: 14706 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
agatatctaggtagcttact

SEQ ID NO: 14707 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGCTT
agaaatgattcagatatcta

SEQ ID NO: 14708 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
gtagtattagtagttaacag

SEQ ID NO: 14709 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
attttcaatattagaaatcc

SEQ ID NO: 14710 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
acatataaacatatgcatat

SEQ ID NO: 14711 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGATT
tttttctatttcaaatttgg

SEQ ID NO: 14712 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
aaaattagttattttagtgt

SEQ ID NO: 14713 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
accttagagataatattgct

SEQ ID NO: 14714 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
gaatttctctgtcattgttg

SEQ ID NO: 14715 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGATT
acacttttactgaaattaga

SEQ ID NO: 14716 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGTTT
agatcagtctctagaaacta

SEQ ID NO: 14717 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
actcattgataagaataagt

SEQ ID NO: 14718 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
aatattactcattgataaga

SEQ ID NO: 14719 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
gaataagtgataagtgttca

SEQ ID NO: 14720 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
aaatcaactcagtaattaac

SEQ ID NO: 14721 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
aaactttgaatacattttga

SEQ ID NO: 14722 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGCTT
ttggggtcaaagccaaagta

SEQ ID NO: 14723 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGCTT
atggataagcaaattgagac

SEQ ID NO: 14724 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGCTT
caggaaaagatcattgtaat

SEQ ID NO: 14725 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
actctaaaaaattgtggaag

SEQ ID NO: 14726 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGATT
aaacctctatcaacttccct

SEQ ID NO: 14727 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
tgatctgtagatttttattg

SEQ ID NO: 14728 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
gtgatttcaagtgcatgatc

SEQ ID NO: 14729 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
gatgtaaccttcatgtgctt

SEQ ID NO: 14730 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
gacttcttgatgtaaccttc

SEQ ID NO: 14731 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
agggcaatttgattattttt

SEQ ID NO: 14732 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
cacagcatgtcaccagggca

SEQ ID NO: 14733 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGCTT
gatcagtcaaggatgcagct

SEQ ID NO: 14734 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
ttagtactgtgattcaaata

SEQ ID NO: 14735 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
aatgacatttaatcttagta

SEQ ID NO: 14736 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
aattatgtaactgtttaatt

SEQ ID NO: 14737 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
gtagaattatgtaactgttt

SEQ ID NO: 14738 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGTTT
atagtagagtagaattatgt

SEQ ID NO: 14739 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGCTT
gagaatcacttatatttaaa

SEQ ID NO: 14740 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
caagaaatgctaattttaga

SEQ ID NO: 14741 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
gaaacttcacttttttgcaa

SEQ ID NO: 14742 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
aatctttccatcttcattgg

SEQ ID NO: 14743 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGATT
tgaaaaatctttccatcttc

SEQ ID NO: 14744 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
tagaccatttgtttttttca

SEQ ID NO: 14745 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tgtagaattgcacttagacc

SEQ ID NO: 14746 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGATT
atttgattctatattttatg

SEQ ID NO: 14747 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
tgctgtttcgtaaaattggc

SEQ ID NO: 14748 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
ttagggattagttacagtta

SEQ ID NO: 14749 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGATT
gcatttgactttgaaagatt

SEQ ID NO: 14750 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGATT
ttaaaaatgcatttgacttt

SEQ ID NO: 14751 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGCTT
atcaaagttttagatttacc

SEQ ID NO: 14752 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
tttagatttttaatcaaagt

SEQ ID NO: 14753 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
tctctctttagatttttaat

SEQ ID NO: 14754 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
tgttatcaagactttctctc

SEQ ID NO: 14755 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGTTT
ttaatgtccttttactatgt

SEQ ID NO: 14756 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
attttgttgacctgataaaa

SEQ ID NO: 14757 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
ttatctttggagatacttaa

SEQ ID NO: 14758 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
acccattcatctattcagtg

SEQ ID NO: 14759 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCTGATT
aacaagcattcatattgttc

SEQ ID NO: 14760 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGCTT
caacaaaaagtatacactct

SEQ ID NO: 14761 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGTGATT
tcatgtacttcaaaggtaaa

SEQ ID NO: 14762 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGTTT
gcccagaattataataggca

SEQ ID NO: 14763 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGCTT
gaaggtattaacaaggtcag

SEQ ID NO: 14764 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGATT
tattgctaccctgaataaaa

SEQ ID NO: 14765 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
cccagagatccttatccaac

SEQ ID NO: 14766 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGCTT
ttagaggtgactgttccacc

SEQ ID NO: 14767 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
tttttcttctatattaatgc

SEQ ID NO: 14768 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
tcccttctgccaatcttcac

SEQ ID NO: 14769 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
tggcataactggatagaaca

SEQ ID NO: 14770 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
tggctatttctgagtcagga

SEQ ID NO: 14771 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGTTT
taatccctatttttttgtgt

SEQ ID NO: 14772 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
caggacaatgtattaagtag

SEQ ID NO: 14773 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGCTT
ctaagacttatccagctctc

SEQ ID NO: 14774 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGCTT
ctagaccaaattcaagttct

SEQ ID NO: 14775 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGATT
ccttctttattgaaaagtaa

SEQ ID NO: 14776 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tttatattttaggtgtttaa

SEQ ID NO: 14777 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGTTT
atgtgtgatttttatatttt

SEQ ID NO: 14778 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGATT
tagtctaccttggtaataat

SEQ ID NO: 14779 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGATT
ttctaatccaccttaatgct

SEQ ID NO: 14780 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGCTT
gattcattgggattctgata

SEQ ID NO: 14781 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
attgtacatttgctgattca

SEQ ID NO: 14782 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGATT
ttgtaatggtattgtacatt

SEQ ID NO: 14783 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
aagaaaatgagtagtagtat

SEQ ID NO: 14784 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
tgcgattctaaaagattaag

SEQ ID NO: 14785 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
ttgcagatgactgcgattct

SEQ ID NO: 14786 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGCGATT
gcatctatatttgcagatga

SEQ ID NO: 14787 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGCTT
ttttggcagctgggggaatg

SEQ ID NO: 14788 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGGGATT
ctgccacgataaggcccaaa

SEQ ID NO: 14789 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGATT
ttgaactgttaaaattgcaa

SEQ ID NO: 14790 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
gaaatctgagatttactgag

SEQ ID NO: 14791 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
accaatcctgagagagaaat

SEQ ID NO: 14792 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGGGATT
tatgctaactttcattaatc

SEQ ID NO: 14793 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
aagtcagagttgtagatagg

SEQ ID NO: 14794 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
ttgaggaggtaggggaaata

SEQ ID NO: 14795 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGATT
aggacttcaacataactttt

SEQ ID NO: 14796 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGATT
cttataaggaccccagttat

SEQ ID NO: 14797 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTAGTTT
aatctctggcccggtactca

SEQ ID NO: 14798 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCAGCTT
tggaggttgttggcaatcct

SEQ ID NO: 14799 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
ctctagtaagtatcctgcct

SEQ ID NO: 14800 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGATT
aaatcaaggtctgagcaagg

SEQ ID NO: 14801 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGCTT
gtaacaaattagcaaaactc

SEQ ID NO: 14802 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
gtgagctgatccaaggatgt

SEQ ID NO: 14803 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
agggctcagggtctagatat

SEQ ID NO: 14804 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCGGGATT
acagctgcaacaatttaata

SEQ ID NO: 14805 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGCTT
cttttttaccactggcagtg

SEQ ID NO: 14806 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGCTT
aaacattaacaacacactac

SEQ ID NO: 14807 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGTTT
catgagaataatactctttt

SEQ ID NO: 14808 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACGGTTT
caaagagatgagttaaaaca

SEQ ID NO: 14809 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGATT
ctagtataagttttcaggtt

SEQ ID NO: 14810 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
attttcagtgctctcctagt

SEQ ID NO: 14811 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
ctagcatcctggtttctcaa

SEQ ID NO: 14812 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGTTT
tctcttttatgacctagcat

SEQ ID NO: 14813 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
atgggtatatttcccctttt

SEQ ID NO: 14814 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
ggctatgggtatatttcccc

SEQ ID NO: 14815 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGTTT
aatccctagcttacttggat

SEQ ID NO: 14816 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
ccaacttaatccctagctta

SEQ ID NO: 14817 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGCTT
taaatgatgccaacttaatc

SEQ ID NO: 14818 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
ttgtatatttcaaaatagct

SEQ ID NO: 14819 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGATT
ttggaggagcgaggtgtggg

SEQ ID NO: 14820 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGCTT
atagtggttatcggaggatg

SEQ ID NO: 14821 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
acatagaatactgtactcct

SEQ ID NO: 14822 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGATT
gagaaaagggaatccttaca

SEQ ID NO: 14823 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
atcaaaaaatcaaaagatat

SEQ ID NO: 14824 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
aattggattatattaaacta

SEQ ID NO: 14825 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGATT
acaaaagcaaatatagacaa

SEQ ID NO: 14826 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGATT
cttcatgatgttgttctagg

SEQ ID NO: 14827 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGCTT
gagaagaaaaaaaacagggg

SEQ ID NO: 14828 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGTTT
atctacacatatacagtcaa

SEQ ID NO: 14829 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGCTT
ggaacaaaaagaacaaagct

SEQ ID NO: 14830 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
catattacccaaagcaatct

SEQ ID NO: 14831 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGATT
agggaaagatattccatgtt

SEQ ID NO: 14832 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGATT
atgaccccatgaaaaaaagt

SEQ ID NO: 14833 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
aaagaaggaagtcaaattct

SEQ ID NO: 14834 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGCTT
atactaaccagggaagagct

SEQ ID NO: 14835 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
aaatcgtcccagggatgcaa

SEQ ID NO: 14836 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
tcaaatccaacagcctatca

SEQ ID NO: 14837 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGCTT
caaagaaaagtccaggacca

SEQ ID NO: 14838 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGATT
aaacagaccaataatgagta

SEQ ID NO: 14839 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAACGTTT
tgcaacttcagaatcattaa

SEQ ID NO: 14840 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
gttctggatcatatcctttg

SEQ ID NO: 14841 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGCTT
agagatagcgtgatgaagat

SEQ ID NO: 14842 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGATT
cactgtaagtagctattggt

SEQ ID NO: 14843 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGCTT
attattataagtatggaatt

SEQ ID NO: 14844 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
attctcataaataattagac

SEQ ID NO: 14845 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
aatagattgtaataaagatt

SEQ ID NO: 14846 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
atgtgtaaaatagattgtaa

SEQ ID NO: 14847 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
ttcagtttatttatgtgtaa

SEQ ID NO: 14848 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
caatttacaaaaacattttt

SEQ ID NO: 14849 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGCTT
atagaatatttgcctcaaat

SEQ ID NO: 14850 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
tgcctttgaaatagtgatgg

SEQ ID NO: 14851 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
attctgtcatttttgttttg

SEQ ID NO: 14852 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tttaaattctgtcatttttg

SEQ ID NO: 14853 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tccagtttaaattctgtcat

SEQ ID NO: 14854 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
cctcttcagattaaaatgtt

SEQ ID NO: 14855 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tttccagcctcttcagatta

SEQ ID NO: 14856 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
aggtctttctttccagcctc

SEQ ID NO: 14857 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
aggttcaagatctagaggaa

SEQ ID NO: 14858 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
gacttctaattatgaacttt

SEQ ID NO: 14859 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATCGATT
ttaaaaaaagtgtttgttgt

SEQ ID NO: 14860 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
ttagcaagccattttaaaaa

SEQ ID NO: 14861 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
tatttttaagtcatgtagca

SEQ ID NO: 14862 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGTTT
gtatgcacaattaaatatac

SEQ ID NO: 14863 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
tgatgttaatattctaatat

SEQ ID NO: 14864 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
tatttgtattttataactga

SEQ ID NO: 14865 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
ggttagctatcttttataac

SEQ ID NO: 14866 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGCTT
gcagagccatgtcaagagtc

SEQ ID NO: 14867 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
aaagcagactcattaaaagg

SEQ ID NO: 14868 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
cagttgctctcagaataaaa

SEQ ID NO: 14869 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGATT
taactctgtcacccatttaa

SEQ ID NO: 14870 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGTTT
gccttttaaggagcaggcat

SEQ ID NO: 14871 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGATT
tttcagcttaaagttagaaa

SEQ ID NO: 14872 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGCTT
aattttaaaaccgtgttcat

SEQ ID NO: 14873 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
atcactgacacaatgtaaat

SEQ ID NO: 14874 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
tatgtacactttaaattatc

SEQ ID NO: 14875 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
ttcctttatataaaatggca

SEQ ID NO: 14876 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
tccctcgatatctatgggcg

SEQ ID NO: 14877 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
ttaaataaataaatcatgat

SEQ ID NO: 14878 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
ctatatttaattgagtgaat

SEQ ID NO: 14879 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
cataagattaaattaaatac

SEQ ID NO: 14880 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
gtctcaaaaaaaatcaatac

SEQ ID NO: 14881 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
ccaagatcgcaccgctgcac

SEQ ID NO: 14882 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGAGATT
atttatagtggacttggaaa

SEQ ID NO: 14883 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ggcatcatttaaaaataatc

SEQ ID NO: 14884 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGCTT
attacaaattacttttatga

SEQ ID NO: 14885 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
ccgtattacaaattactttt

SEQ ID NO: 14886 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
ctagtgagtcaaggtatgta

SEQ ID NO: 14887 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGATT
caaacaattttatacttctt

SEQ ID NO: 14888 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ttaacacgttaatacatgta

SEQ ID NO: 14889 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
aaacactctccacactttgc

SEQ ID NO: 14890 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
ggtcataaacactctccaca

SEQ ID NO: 14891 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGATT
tctatctcctagtgctcacc

SEQ ID NO: 14892 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCAGCTT
gccttcacactatggcccta

SEQ ID NO: 14893 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
tcaaactttttccccagttg

SEQ ID NO: 14894 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
tttgtagagacaaggtttca

SEQ ID NO: 14895 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGTTT
tttaaaaaagtttgtagaga

SEQ ID NO: 14896 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
cacccagctaatttttttaa

SEQ ID NO: 14897 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGCTT
ctggagtacagtggtgctat

SEQ ID NO: 14898 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCAGATT
tatttgattattttcgctca

SEQ ID NO: 14899 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
gcatttactctagtttactt

SEQ ID NO: 14900 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGTTT
tgcttccattttgcatttac

SEQ ID NO: 14901 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
agcagagtctcaactgatgc

SEQ ID NO: 14902 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGTTT
acacagtctccctccacagt

SEQ ID NO: 14903 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
gagccttcccatgcttcatc

SEQ ID NO: 14904 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGCTT
aaaggtatctttgagccttc

SEQ ID NO: 14905 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
ttttcttactagttcttaat

SEQ ID NO: 14906 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
cttcctgaagattcatctgg

SEQ ID NO: 14907 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGATT
gactttacacaacagcttcc

SEQ ID NO: 14908 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGCTT
ttttgtgcgtgactttacac

SEQ ID NO: 14909 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
taacattgcatgtagtgatg

SEQ ID NO: 14910 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
gtaagaatgcttcatatact

SEQ ID NO: 14911 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGCTT
tgaatacagcaaagtggtaa

SEQ ID NO: 14912 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
atgaatgctgaggaacttag

SEQ ID NO: 14913 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCCGATT
gtgccaattgcacctgggga

SEQ ID NO: 14914 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
tcaaggaaaaagataaaatc

SEQ ID NO: 14915 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGATT
aaaagcattttccaaaaagc

SEQ ID NO: 14916 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGATT
agaccctgatgcaaacaacc

SEQ ID NO: 14917 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGTTT
aaggtgcagaaatcttcgtt

SEQ ID NO: 14918 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGATT
ttttgggttcataaaagaga

SEQ ID NO: 14919 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGTTT
taatgatagatgaatgctag

SEQ ID NO: 14920 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCTGTTT
agtcacaattgttttgttct

SEQ ID NO: 14921 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
gcacaatagaaaatagtcac

SEQ ID NO: 14922 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCACGCTT
tcacattaagcagtattcta

SEQ ID NO: 14923 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGCTT
ttcaaggggcaggtcctttt

SEQ ID NO: 14924 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
taattaactcagaaataaaa

SEQ ID NO: 14925 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
ttaaatataatttacaattt

SEQ ID NO: 14926 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
tttttgtttcctggataaaa

SEQ ID NO: 14927 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
aatgccaattcaatttcctt

SEQ ID NO: 14928 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
cgatttttaaaacatgaggt

SEQ ID NO: 14929 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTCGATT
ttctcttcagttaggtctta

SEQ ID NO: 14930 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
ctttacttacatctcagaga

SEQ ID NO: 14931 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
gcaattatcaaaattgttca

SEQ ID NO: 14932 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGATT
tgacaactattaaaccattt

SEQ ID NO: 14933 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGATT
ttaaaatggtttaacgcttg

SEQ ID NO: 14934 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAACGCTT
tgcaccctgttaaaatggtt

SEQ ID NO: 14935 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
gagccactgcaccctgttaa

SEQ ID NO: 14936 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
gttatagaaatattagagac

SEQ ID NO: 14937 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
gatgatacaaatggacttta

SEQ ID NO: 14938 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
cattttattaatatttcttc

SEQ ID NO: 14939 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
ttaggaaaacatttggaaaa

SEQ ID NO: 14940 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
aattgaaatggttaaggacc

SEQ ID NO: 14941 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGCTT
acattagagttatatgctaa

SEQ ID NO: 14942 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGTTT
aacagaggggatatattggt

SEQ ID NO: 14943 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
tgttttcctttgaaaggcaa

SEQ ID NO: 14944 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
catggacactggtgtgagag

SEQ ID NO: 14945 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGTTT
gttctagattgagacttaag

SEQ ID NO: 14946 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGATT
ctgacacttaaagaaagagt

SEQ ID NO: 14947 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
tctaccaataaggttaaata

SEQ ID NO: 14948 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
tggtctaatccttgttttta

SEQ ID NO: 14949 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
ccaattacccatggtctaat

SEQ ID NO: 14950 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
gtattgtttagataggaagg

SEQ ID NO: 14951 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
tgaaaagaaaggtatttagg

SEQ ID NO: 14952 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ccaataatcacaaataattt

SEQ ID NO: 14953 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
tttttgtatttttagtagag

SEQ ID NO: 14954 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
tgcctcagcctcctgagtag

SEQ ID NO: 14955 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTCGCTT
tttttttttttgagatggaa

SEQ ID NO: 14956 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
ttataagctcctatagcagg

SEQ ID NO: 14957 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGATT
tgtatttataagctcctata

SEQ ID NO: 14958 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
cattctctttgtttcttctt

SEQ ID NO: 14959 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
tggaatgaaatgcacattct

SEQ ID NO: 14960 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGTTT
ttgtagtaataaataagctt

SEQ ID NO: 14961 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGCTT
ccctcaagttgtagtaataa

SEQ ID NO: 14962 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGATT
actgcacaaaaaatatacat

SEQ ID NO: 14963 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGATT
ggcatttatgcagcacaaat

SEQ ID NO: 14964 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
tccttgtaaccaccataaaa

SEQ ID NO: 14965 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGCTT
acgttgacttgtcacagttg

SEQ ID NO: 14966 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGCTT
atactgattagtgaaaactt

SEQ ID NO: 14967 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGATT
tttattttttttcttcctta

SEQ ID NO: 14968 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGCTT
actttttgaattagtgtttt

SEQ ID NO: 14969 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
aatctgcctactttttgaat

SEQ ID NO: 14970 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
tatcatttggccctttacga

SEQ ID NO: 14971 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGCTT
ttcatttacgtatcttctat

SEQ ID NO: 14972 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGATT
tgtgtggccctgggagctaa

SEQ ID NO: 14973 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
ctgcctattcattttaaggc

SEQ ID NO: 14974 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
gaaagagaacgaaattttgt

SEQ ID NO: 14975 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
gctggtcaagctatgtgcct

SEQ ID NO: 14976 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGATT
gaacgacttcttccactcct

SEQ ID NO: 14977 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGATT
atcctggccaacattgaaca

SEQ ID NO: 14978 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
tgattaacattaaactttat

SEQ ID NO: 14979 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
aaacattgaaaagattttca

SEQ ID NO: 14980 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
aatcaagattggaaacattg

SEQ ID NO: 14981 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGATT
ctttaccctttgaacaaaaa

SEQ ID NO: 14982 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
acaatattataggacttaaa

SEQ ID NO: 14983 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
gcaatcctgaactaaaagta

SEQ ID NO: 14984 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGTTT
aaatatcacaaattatgata

SEQ ID NO: 14985 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGATT
aaagcacattcctctaatat

SEQ ID NO: 14986 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
gcttgtggcttacagaattt

SEQ ID NO: 14987 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGCTT
ttatttcagagtaagaagct

SEQ ID NO: 14988 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGCTT
caataatttatttcagagta

SEQ ID NO: 14989 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGATT
ttgggaatttgaatcaaaag

SEQ ID NO: 14990 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
ctataataaaggggtatttc

SEQ ID NO: 14991 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGATT
agctctttctagcagatgtg

SEQ ID NO: 14992 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
ttgacagccttattgtgact

SEQ ID NO: 14993 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGATT
tgcagctgaaatggtattaa

SEQ ID NO: 14994 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
ttattatcattgtgttgatt

SEQ ID NO: 14995 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGATT
aacagtgattattatcattg

SEQ ID NO: 14996 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
cacagtaaatgctaagcaaa

SEQ ID NO: 14997 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGCTT
atgagcactgacaggacagt

SEQ ID NO: 14998 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tagtgactgtgtcaattacc

SEQ ID NO: 14999 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
ctcaaaatttcagtatcaac

SEQ ID NO: 15000 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
tttgcaatgcacttttgtgt

SEQ ID NO: 15001 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
ccttgagtcaaagtgtaccc

SEQ ID NO: 15002 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGATT
ttcccttagaatcttctttg

SEQ ID NO: 15003 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
ctgcatccctgtgaactcag

SEQ ID NO: 15004 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGTTT
tttggaaaaaggcaggaata

SEQ ID NO: 15005 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
aaattgtctacaaatattcc

SEQ ID NO: 15006 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
tcaatgtctatataagataa

SEQ ID NO: 15007 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGCTT
catttttagggccagagaat

SEQ ID NO: 15008 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGTTT
taactcagggtaaacaaaat

SEQ ID NO: 15009 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGCTT
aacttcaaagacttaatgaa

SEQ ID NO: 15010 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGCTT
tcttgggaggattaaatgct

SEQ ID NO: 15011 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
atcatattcttgggaggatt

SEQ ID NO: 15012 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGATT
tttcatttatcatattcttg

SEQ ID NO: 15013 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGATT
cccaaagtcctgggtttgaa

SEQ ID NO: 15014 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
gtcctcagagtcccaaagtc

SEQ ID NO: 15015 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
gctttgacataatagtagtg

SEQ ID NO: 15016 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
tttcagaaaacctatggatg

SEQ ID NO: 15017 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
tcacaccttcctaattacat

SEQ ID NO: 15018 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
gttaccatcttgggagttga

SEQ ID NO: 15019 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGTTT
atatgaatggatgtgtagag

SEQ ID NO: 15020 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
cttattgtgtgttatgtact

SEQ ID NO: 15021 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
gatcttgcaattaccatttg

SEQ ID NO: 15022 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGATT
aaaaatgtccaccttggtgg

SEQ ID NO: 15023 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
caaatggctgactccatgtt

SEQ ID NO: 15024 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGATT
gtttcaatattagaatgcct

SEQ ID NO: 15025 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
ttcaaaatctaaactataaa

SEQ ID NO: 15026 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGCTT
taatagacttacataagagg

SEQ ID NO: 15027 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGCTT
tttcacttccttaccctctc

SEQ ID NO: 15028 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
tctctgaaagatgcccacat

SEQ ID NO: 15029 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
ctgttaaggaaacatagttc

SEQ ID NO: 15030 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGTTT
cacctgtgaactattacagc

SEQ ID NO: 15031 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
ttctagttgcttggttctag

SEQ ID NO: 15032 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGATT
ttatttctagttgcttggtt

SEQ ID NO: 15033 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
gtcctccataaattatttct

SEQ ID NO: 15034 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGCTT
gtgacaactttacaaactgt

SEQ ID NO: 15035 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGTGATT
aacaaggttaacccagagct

SEQ ID NO: 15036 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
tgatctgacctttcaaagat

SEQ ID NO: 15037 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
atactgatggaattgttttt

SEQ ID NO: 15038 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
taaccaatggatactgatgg

SEQ ID NO: 15039 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
gaagaattcagagaccataa

SEQ ID NO: 15040 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGATT
gtaataatcttcttttactg

SEQ ID NO: 15041 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
gattctgttcttaagacatt

SEQ ID NO: 15042 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
tatcttatacctacaattta

SEQ ID NO: 15043 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGATT
tactcactacagctatataa

SEQ ID NO: 15044 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
acaagaatatgaagcaagca

SEQ ID NO: 15045 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGCTT
gatgatataacaaaaaagca

SEQ ID NO: 15046 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGTTT
acacagcactacagcacttt

SEQ ID NO: 15047 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
cagaaatttatcagagaata

SEQ ID NO: 15048 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGCTT
cagtaagagacaaccattac

SEQ ID NO: 15049 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGCTT
gagaggtcacctctttcaga

SEQ ID NO: 15050 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
tacacttgttatgcatgagt

SEQ ID NO: 15051 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGTTT
ttttaaatttgaattagttt

SEQ ID NO: 15052 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
acatagtgttttaaatttga

SEQ ID NO: 15053 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
tggcctgcatggaaccaaca

SEQ ID NO: 15054 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
tgatagatctagagttgtat

SEQ ID NO: 15055 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
acatatctatgcctgtatgt

SEQ ID NO: 15056 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGTTT
acagactatagcacagaaaa

SEQ ID NO: 15057 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
atttgtttaatctgacaaat

SEQ ID NO: 15058 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
acatgtctacatggaaaata

SEQ ID NO: 15059 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGTTT
cataaaattgtggcacaata

SEQ ID NO: 15060 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGTTT
ttaatgaagtttcttcattt

SEQ ID NO: 15061 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
agattatttcatatttttaa

SEQ ID NO: 15062 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGATT
tatataatttatatcagatt

SEQ ID NO: 15063 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGATT
taaaatactatataatttat

SEQ ID NO: 15064 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ggaatcaaactttgcttgca

SEQ ID NO: 15065 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
taaatttctgtggaatcaaa

SEQ ID NO: 15066 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGCTT
tgacctctatgtgtgcatga

SEQ ID NO: 15067 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
atttcaatttgaataaatgc

SEQ ID NO: 15068 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGCTT
ataagcttcaaacatatgct

SEQ ID NO: 15069 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGCTT
caagggctttgactaaccca

SEQ ID NO: 15070 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGCTT
gctgcattaccaatatcagc

SEQ ID NO: 15071 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGTTT
agtgagatctttctcattcc

SEQ ID NO: 15072 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGCTT
ggttagagaaaggtgtctga

SEQ ID NO: 15073 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGATT
ctaagtggttagagaaaggt

SEQ ID NO: 15074 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGTTT
cctccatataaatgaaacat

SEQ ID NO: 15075 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAGGCTT
tgctatctctccaatgtgca

SEQ ID NO: 15076 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGTTT
cctaagttgaaacggaggct

SEQ ID NO: 15077 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
atgagatgatacattattat

SEQ ID NO: 15078 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGCTT
tactgctatctttttcaggt

SEQ ID NO: 15079 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGATT
atcccatttctatgaagaaa

SEQ ID NO: 15080 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGATT
ttgtctattaattttataat

SEQ ID NO: 15081 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
ctttttctataggaacacac

SEQ ID NO: 15082 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGACGTTT
aacttctgatgacagcgtaa

SEQ ID NO: 15083 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGCTT
agccctcatgctccccaatg

SEQ ID NO: 15084 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGTTT
caatgagagcagaaggggct

SEQ ID NO: 15085 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
gaagcagcagaacaagtctt

SEQ ID NO: 15086 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
accactcagcattcgtggct

SEQ ID NO: 15087 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCACGTTT
atcagtaggtgcttcagcaa

SEQ ID NO: 15088 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGCTT
tgaagtgtacttctatcagt

SEQ ID NO: 15089 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGTTT
ctgaattgcttcgtttttaa

SEQ ID NO: 15090 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTCGTTT
gttttcttctcactgaattg

SEQ ID NO: 15091 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGCTT
aagaagttttcttctcactg

SEQ ID NO: 15092 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
tgtttcatcccttaagtgga

SEQ ID NO: 15093 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
ctgaaaggatgaattctaca

SEQ ID NO: 15094 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGATT
tccaatttttttgtgaagcc

SEQ ID NO: 15095 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
tcaatgcaaagaaccataca

SEQ ID NO: 15096 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGATT
actgagctcttagtatgtaa

SEQ ID NO: 15097 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
ctattgaactagatccttcc

SEQ ID NO: 15098 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGTTT
atatgacaggagcagtccaa

SEQ ID NO: 15099 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGATT
aaaaatctagttaaaaatct

SEQ ID NO: 15100 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGTTT
ttctgttttccttaggtctt

SEQ ID NO: 15101 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
tccccaagatgaaccattgc

SEQ ID NO: 15102 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
cacaaatccccaagatgaac

SEQ ID NO: 15103 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGCTT
aaccttcatctctcaggcct

SEQ ID NO: 15104 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
gtagtgccatagtctgttaa

SEQ ID NO: 15105 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGTTT
tggttaaaaactaatcttag

SEQ ID NO: 15106 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGCTT
tgtatttagtctgtgttttg

SEQ ID NO: 15107 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
cttttatatttgtatttagt

SEQ ID NO: 15108 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
caatcatttttgaaagacct

SEQ ID NO: 15109 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
gcatttatggaaagatgtac

SEQ ID NO: 15110 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGATT
gatagtgagtgatttcattg

SEQ ID NO: 15111 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGATT
agaactcgggagaggatagt

SEQ ID NO: 15112 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
cagaggacagcatcagaaga

SEQ ID NO: 15113 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGATT
atgtcctgtcctagggtttc

SEQ ID NO: 15114 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGTTT
aggtgaaagatgtcctgtcc

SEQ ID NO: 15115 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGATT
gatcatttcatgtttaaagg

SEQ ID NO: 15116 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
gtgtaaagaaaacgatcatt

SEQ ID NO: 15117 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGCTT
agtttaattctaaaatacaa

SEQ ID NO: 15118 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
taagcaaattaataacatgt

SEQ ID NO: 15119 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCGAGTTT
tgtcttattgcatggtttat

SEQ ID NO: 15120 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGTTT
tcaaattgtctgtcttattg

SEQ ID NO: 15121 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGATT
tctttattaaaccatagagt

SEQ ID NO: 15122 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGCTT
cttaccactttcttacaata

SEQ ID NO: 15123 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
gtactacctagggaattccc

SEQ ID NO: 15124 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
atgtttttacaagaattttt

SEQ ID NO: 15125 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
ttcatttatatctttatttc

SEQ ID NO: 15126 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
gggaggtaagatgacttttt

SEQ ID NO: 15127 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
gaaaaatcttttagaataat

SEQ ID NO: 15128 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
tattattttgccatagaact

SEQ ID NO: 15129 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGTTT
agttgccttaacatttgtct

SEQ ID NO: 15130 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGCTT
tcttcagtgtaaatgtttga

SEQ ID NO: 15131 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ccagagagattcttcagtgt

SEQ ID NO: 15132 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGATT
cctccttaatcctctttcca

SEQ ID NO: 15133 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
ttaggttgtcatagattctc

SEQ ID NO: 15134 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGATT
gtgtggctaatttaggttgt

SEQ ID NO: 15135 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGATT
atcatgttttgttaatgtca

SEQ ID NO: 15136 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
ggtatgactaaaacagtgca

SEQ ID NO: 15137 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
ccagagtaccaattgtatac

SEQ ID NO: 15138 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGATT
atatatacacacatacacac

SEQ ID NO: 15139 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
gaggaaaaatcttttagaat

SEQ ID NO: 15140 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
atatataaacacatggaact

SEQ ID NO: 15141 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGATT
tatatgcttggccttctcca

SEQ ID NO: 15142 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
tacaacagaggctctgcggt

SEQ ID NO: 15143 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
gaagaagctgaggtactgtt

SEQ ID NO: 15144 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
ctacatgatcttctttgtcg

SEQ ID NO: 15145 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGATT
acatgagattataccaaact

SEQ ID NO: 15146 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
ctctttatatttttgataac

SEQ ID NO: 15147 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
gtactgaaaatgtgtttaat

SEQ ID NO: 15148 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
ctatattcttcgtactgaaa

SEQ ID NO: 15149 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
ttcagactgtaggaaaaaat

SEQ ID NO: 15150 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
cctaaaatttgaaagtgagc

SEQ ID NO: 15151 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
gaaaaaaaaatctctgtacc

SEQ ID NO: 15152 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
tggtaaagacacatgcacac

SEQ ID NO: 15153 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
ccattactgggtatataccc

SEQ ID NO: 15154 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGCTT
gagaaaatgtggagaaatag

SEQ ID NO: 15155 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
ctacaaagacacatgcacac

SEQ ID NO: 15156 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
ttattaaaaagttgagaaac

SEQ ID NO: 15157 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGATT
ccatctcaagtcagtcagaa

SEQ ID NO: 15158 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
tttatgtgatggattacatt

SEQ ID NO: 15159 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
gtcattggttctgtttatgt

SEQ ID NO: 15160 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
catgtggtttttgtcattgg

SEQ ID NO: 15161 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
tgcatctattgagataatca

SEQ ID NO: 15162 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
ccatcaatacctagtttatt

SEQ ID NO: 15163 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGTTT
tgagatatgttccatcaata

SEQ ID NO: 15164 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGTTT
attcagtatgatattggcta

SEQ ID NO: 15165 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
cagtttttaaagggaatgct

SEQ ID NO: 15166 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGCTT
cttgtgccagtttttaaagg

SEQ ID NO: 15167 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGTTT
agagggcatccttgtcttgt

SEQ ID NO: 15168 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGATT
accctttatttctttctctt

SEQ ID NO: 15169 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCGGGTTT
gagttttggggctgagatga

SEQ ID NO: 15170 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGTTT
tgaagttgcttatcagttta

SEQ ID NO: 15171 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGTTT
ataccttgctgaagttgctt

SEQ ID NO: 15172 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
gtatcctgataccttgctga

SEQ ID NO: 15173 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
gaatgcctgtgatttttgca

SEQ ID NO: 15174 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
ttgttggtgtataggaatgc

SEQ ID NO: 15175 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
agtttattcatgatttggct

SEQ ID NO: 15176 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGATT
aattgcaaatgggagtttat

SEQ ID NO: 15177 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGAGTTT
tctttatagcaattgcaaat

SEQ ID NO: 15178 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGCTT
cctctcttgtttccttgagt

SEQ ID NO: 15179 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
ttccatttgtttgtgtcctc

SEQ ID NO: 15180 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tgagtatggaatgtttttcc

SEQ ID NO: 15181 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
tcttcctatccatgagtatg

SEQ ID NO: 15182 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
cagtatggccatttacatga

SEQ ID NO: 15183 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
tggtttcatatgaaatttaa

SEQ ID NO: 15184 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGTTT
ctttgctatatgtgctcttt

SEQ ID NO: 15185 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
gatgcctccagctttgttct

SEQ ID NO: 15186 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
aagtcaggtaggctgatgcc

SEQ ID NO: 15187 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
tggttactgtaacctcatag

SEQ ID NO: 15188 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
ctgtttgggtaccactacca

SEQ ID NO: 15189 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGTTT
tctattccattggcctatat

SEQ ID NO: 15190 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
tgtcaggtttgtcgaagatc

SEQ ID NO: 15191 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGTTT
ttccacattgcttgtttttg

SEQ ID NO: 15192 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
tagggaatcctttccacatt

SEQ ID NO: 15193 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
tatatagggaatcctttcca

SEQ ID NO: 15194 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGCTT
cagttttctgcatatggcta

SEQ ID NO: 15195 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
gtgtaaggaaggagcccagt

SEQ ID NO: 15196 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGTTT
tataaggtgtaaggaaggag

SEQ ID NO: 15197 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGTTT
cttctagggttttcatggtt

SEQ ID NO: 15198 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGTTT
aggttttcttctagggtttt

SEQ ID NO: 15199 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGTTT
gtgttgcctaggttttcttc

SEQ ID NO: 15200 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGTTT
tatttcctgaatggtgttgc

SEQ ID NO: 15201 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGCTT
tcaattttggctttggttgc

SEQ ID NO: 15202 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
gttatatcccatttgtcaat

SEQ ID NO: 15203 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
cttttgctgtgcagaagctc

SEQ ID NO: 15204 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTAGTTT
gtttgcctgttcactctgat

SEQ ID NO: 15205 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
gccaaatttttctcccattc

SEQ ID NO: 15206 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGATT
tattagacctttgtcagatg

SEQ ID NO: 15207 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
ataaatttgtttaagttact

SEQ ID NO: 15208 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
aaatgttaattatcttataa

SEQ ID NO: 15209 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
actatcctaaattcacttta

SEQ ID NO: 15210 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGTTT
ttttctcagaatagctgcag

SEQ ID NO: 15211 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
ttattctatagtacacataa

SEQ ID NO: 15212 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
agccaaaaggaaggagacca

SEQ ID NO: 15213 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGATT
ttgctcccaactgtagactt

SEQ ID NO: 15214 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAAGTTT
taaagatgcaattcatttct

SEQ ID NO: 15215 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
ctctgatgttcacctgctca

SEQ ID NO: 15216 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCGTGCTT
gcacatggactgttttccat

SEQ ID NO: 15217 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGTTT
tcaagctgctcctgcacatg

SEQ ID NO: 15218 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ttaagtaccaggacatactg

SEQ ID NO: 15219 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
tatcttattaccaaaattat

SEQ ID NO: 15220 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGTTT
tatgttaagagcctgtatta

SEQ ID NO: 15221 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGATT
gccttgtttaggctaatgac

SEQ ID NO: 15222 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
tttcagctgggccttcttag

SEQ ID NO: 15223 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGAGCTT
gaaaccctgattatggctac

SEQ ID NO: 15224 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGATT
tgtgtgaaaattggcagaaa

SEQ ID NO: 15225 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
gtaacttttcagtaaggcta

SEQ ID NO: 15226 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
gtccccctatagaagaaacc

SEQ ID NO: 15227 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
gatgatgatgctaatggcag

SEQ ID NO: 15228 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
aaaacgtctgttgaaaattt

SEQ ID NO: 15229 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGCTT
ccaagaattatacagacaga

SEQ ID NO: 15230 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGCTT
gtagcatcagctgcataagc

SEQ ID NO: 15231 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
atatattcaactgtccatct

SEQ ID NO: 15232 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGATT
tgttttggccactctaagca

SEQ ID NO: 15233 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
gactcataggtgactgaatg

SEQ ID NO: 15234 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
caaattagtctttgattcta

SEQ ID NO: 15235 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
cagtcagtttgcaaattagt

SEQ ID NO: 15236 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGTTT
gagaaggaaaagaatgttca

SEQ ID NO: 15237 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
acagattcagggtatgtaat

SEQ ID NO: 15238 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
gctctcctttgtggtttcag

SEQ ID NO: 15239 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
gatccaaagatgctctcctt

SEQ ID NO: 15240 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
tttacctcctttatcacaat

SEQ ID NO: 15241 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGATT
atgtttattgcctagcctct

SEQ ID NO: 15242 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
tttatttatcgtgtttattg

SEQ ID NO: 15243 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCGTGTTT
aaaactaatgattttattta

SEQ ID NO: 15244 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
taaaggaggtctcataaaac

SEQ ID NO: 15245 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
cttctttgtcacacttaggt

SEQ ID NO: 15246 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGCTT
caccaacttcatctctgcct

SEQ ID NO: 15247 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGCTT
gtagccacactggccatctt

SEQ ID NO: 15248 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGTTT
gtttgtataagtgcacccta

SEQ ID NO: 15249 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGTTT
tgtatggtagcctataccat

SEQ ID NO: 15250 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
tgagtacagtagcccactct

SEQ ID NO: 15251 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
atatatataatggtgatctc

SEQ ID NO: 15252 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGTTT
cggagtattgtaccacataa

SEQ ID NO: 15253 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
ggtgaaacatggaaaatctg

SEQ ID NO: 15254 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
gatatttaagagagatgaca

SEQ ID NO: 15255 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGATT
actccaaaagtctcccaata

SEQ ID NO: 15256 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGATT
ctgatttcatagtctttctt

SEQ ID NO: 15257 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGATT
caacattcaaatccaagaat

SEQ ID NO: 15258 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGCTT
agatgcagcagctaaggctt

SEQ ID NO: 15259 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGCTT
tattttacagatgcagcagc

SEQ ID NO: 15260 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
atgtgtggatcacagtatca

SEQ ID NO: 15261 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
gtttaactaattataataac

SEQ ID NO: 15262 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
agttttatctcaaattgtat

SEQ ID NO: 15263 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
tgatgatgtgtaattcaatc

SEQ ID NO: 15264 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
cacctcaaactgcaaggctt

SEQ ID NO: 15265 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGCTT
tacatttgcacctcaaactg

SEQ ID NO: 15266 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGCTT
aggttcaggagtgttttcag

SEQ ID NO: 15267 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGTTT
ccatccttcccgaggttcag

SEQ ID NO: 15268 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGTTT
catccttattaaaatatttt

SEQ ID NO: 15269 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
gttgataaatgtgaaccagc

SEQ ID NO: 15270 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
aacctagagtgagctacctg

SEQ ID NO: 15271 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
tagttgtttagaaattattg

SEQ ID NO: 15272 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
atcttaataatttaatgtct

SEQ ID NO: 15273 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCGTGATT
gcgtgagccactgcgcccgg

SEQ ID NO: 15274 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGGGTTT
ttttgtatttttagtagaga

SEQ ID NO: 15275 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGATT
ttctcagtatatacctagta

SEQ ID NO: 15276 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
gttgctgtaaacattcatgt

SEQ ID NO: 15277 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
cattgtatgtatatgctata

SEQ ID NO: 15278 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGCTT
atccatggtatagtatgtat

SEQ ID NO: 15279 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ctggcttcttacacctagca

SEQ ID NO: 15280 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGCTT
ataatatatggctttttgta

SEQ ID NO: 15281 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGCTT
atacatggaagcatataata

SEQ ID NO: 15282 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
ccctagggatttacccactc

SEQ ID NO: 15283 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGATT
actaatctactttctgtccc

SEQ ID NO: 15284 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
tgctgcattcccttttaaaa

SEQ ID NO: 15285 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGATT
aaacttcacccagaatcttc

SEQ ID NO: 15286 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGTTT
gcccagtcctgatcccctgc

SEQ ID NO: 15287 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGTTT
ttcctatctccttcatctac

SEQ ID NO: 15288 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
aatatttgacatttaataga

SEQ ID NO: 15289 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
aaaacaggatattctcttcc

SEQ ID NO: 15290 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
ctgctgaaaaacatacaatt

SEQ ID NO: 15291 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGATT
cactgatgataatgaatgcc

SEQ ID NO: 15292 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGATT
ccagcatggaaaagacagat

SEQ ID NO: 15293 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGTTT
ataaccattcacttggttgt

SEQ ID NO: 15294 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGATT
tttgagtgcaaatttgatgt

SEQ ID NO: 15295 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
tgaggaagagaaaattctac

SEQ ID NO: 15296 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
agatgattgagttcaaaccc

SEQ ID NO: 15297 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
aagactgcagagttatcaaa

SEQ ID NO: 15298 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGTTT
aaatatatgggtttttgtat

SEQ ID NO: 15299 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGTTT
gctggcatttaaaaaaatat

SEQ ID NO: 15300 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
aaaacatattgtagaaacag

SEQ ID NO: 15301 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGTTT
tatagaaatcagagggcctg

SEQ ID NO: 15302 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGATT
ggatatataatatagagaat

SEQ ID NO: 15303 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGTTT
ggaagcattgaggatgactt

SEQ ID NO: 15304 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
caaagtctgtagagcttgct

SEQ ID NO: 15305 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGCTT
agctcaacatacaaagtctg

SEQ ID NO: 15306 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
tcatctaggcaagagaaaat

SEQ ID NO: 15307 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGCTT
aataagaaaggtaagttgaa

SEQ ID NO: 15308 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGATT
ttgctgtctgtcttgtgcac

SEQ ID NO: 15309 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGTTT
ggacatttcagcccatggga

SEQ ID NO: 15310 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTGGTTT
aaagaatggaaaaacagcag

SEQ ID NO: 15311 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGTTT
gtcctgaataaagggagggt

SEQ ID NO: 15312 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
gtgagtctatgtgtgggggg

SEQ ID NO: 15313 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
aagatagtaagaagccataa

SEQ ID NO: 15314 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
catctagtgggaatgaaaaa

SEQ ID NO: 15315 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGCTT
agcctcagcccttgctttca

SEQ ID NO: 15316 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGCTT
caataaatgatagcctcagc

SEQ ID NO: 15317 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGTTT
atttattggtgcgtttatta

SEQ ID NO: 15318 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGCGTTT
attcaaactttcatttattg

SEQ ID NO: 15319 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
gaagccatttttgactgcat

SEQ ID NO: 15320 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
aaatcaagtctgaattttgc

SEQ ID NO: 15321 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
gtgtttaaatcaagtctgaa

SEQ ID NO: 15322 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGTTT
gaaatgtagttttagtgaag

SEQ ID NO: 15323 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
ttctttattttcttctgaaa

SEQ ID NO: 15324 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATCGCTT
tcaggaggctgaggcaggag

SEQ ID NO: 15325 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGCTT
tttaattcatcgctttctgg

SEQ ID NO: 15326 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATCGCTT
taatcaaatttaatttaatt

SEQ ID NO: 15327 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTAGATT
gcaatttgtttacatatgaa

SEQ ID NO: 15328 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tactaatagattagaatgca

SEQ ID NO: 15329 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
acttgttacaagaatatact

SEQ ID NO: 15330 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
ggttggctgaagctcagctg

SEQ ID NO: 15331 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGCTT
acaaaaacagcttgattgct

SEQ ID NO: 15332 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGCTT
gtgacgcacaaaaacagctt

SEQ ID NO: 15333 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGATT
gggagtgacgcacaaaaaca

SEQ ID NO: 15334 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGCTT
aaaagggagtgacgcacaaa

SEQ ID NO: 15335 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
ctgaaataagataataataa

SEQ ID NO: 15336 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGCTT
attttcaacaaattaaattt

SEQ ID NO: 15337 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
atttctgagtttatactgtg

SEQ ID NO: 15338 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGTTT
tctgagtcttgctcctattt

SEQ ID NO: 15339 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
tttaccacacttatttaaac

SEQ ID NO: 15340 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
gagtaacttacatttaatat

SEQ ID NO: 15341 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGATT
ccagtttctgattgttacaa

SEQ ID NO: 15342 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
tatttaccctcttttccagt

SEQ ID NO: 15343 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
tttttatatttaccctcttt

SEQ ID NO: 15344 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
aaactgaaagttttgaagta

SEQ ID NO: 15345 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
gaagccttaacaagaaaact

SEQ ID NO: 15346 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGATT
aggaaatgagggaggaaagg

SEQ ID NO: 15347 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGATT
aatattggatgaagatatga

SEQ ID NO: 15348 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGTTT
cttaattcagaagtatcaat

SEQ ID NO: 15349 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
atctgtatgcactctcagaa

SEQ ID NO: 15350 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
ataggctgatggcaagatat

SEQ ID NO: 15351 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGCTT
cgagtttcatagctgttttt

SEQ ID NO: 15352 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGTTT
taaccaatgacgagtttcat

SEQ ID NO: 15353 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGAGTTT
catccactttgtaaccaatg

SEQ ID NO: 15354 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGCTT
gtacaaagcaaaatcatttg

SEQ ID NO: 15355 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
ctgtatcttgatagtattcc

SEQ ID NO: 15356 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
tatgatagatttttatactt

SEQ ID NO: 15357 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGATT
taatgtgacatatttattat

SEQ ID NO: 15358 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
accattacatttaacaatat

SEQ ID NO: 15359 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
gtgaatttgggtcatgttat

SEQ ID NO: 15360 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGCTT
gctctcttttaataatgaaa

SEQ ID NO: 15361 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tcatgggaaacctgaagcat

SEQ ID NO: 15362 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGTGTTT
cctgactgtgttctgtctga

SEQ ID NO: 15363 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGCTT
ggctttgatccagtcagtga

SEQ ID NO: 15364 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGGGCTT
tcaggcctgaagacaattgt

SEQ ID NO: 15365 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGCTT
tgtgttttttgtttcgattc

SEQ ID NO: 15366 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTCGATT
aggaaagcttgtgttttttg

SEQ ID NO: 15367 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tttctaggaaagcttgtgtt

SEQ ID NO: 15368 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
gcatgactttctaggaaagc

SEQ ID NO: 15369 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGCTT
tataatgcatgactttctag

SEQ ID NO: 15370 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
tgaattaggttacttaaggt

SEQ ID NO: 15371 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGCTT
tatataaaatagcaaaccca

SEQ ID NO: 15372 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
cttacaaaaattatttttaa

SEQ ID NO: 15373 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
gtgccatttatagagaagtg

SEQ ID NO: 15374 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
tttggtgccatttatagaga

SEQ ID NO: 15375 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
aggtgtcactatatgctgta

SEQ ID NO: 15376 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
agcatggggatattgcatga

SEQ ID NO: 15377 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
ggaaaatttcaatccatttt

SEQ ID NO: 15378 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
gtctgagggtttgtttttcc

SEQ ID NO: 15379 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
atcttccctcctgtctgagg

SEQ ID NO: 15380 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGGGTTT
tgaaatcttccctcctgtct

SEQ ID NO: 15381 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
tcattatcaaaagtcaacct

SEQ ID NO: 15382 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
ttttaattaaatttgatttc

SEQ ID NO: 15383 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
ctttatgcaattttaattaa

SEQ ID NO: 15384 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
cccctattacagatatgtga

SEQ ID NO: 15385 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTCGTTT
ctatttgggagttgttcttt

SEQ ID NO: 15386 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGCTT
cttcgaactttcagagtatt

SEQ ID NO: 15387 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
acagaatttgtaaacctagg

SEQ ID NO: 15388 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
tctatctaaattctgaataa

SEQ ID NO: 15389 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
aataatatataatatctgta

SEQ ID NO: 15390 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
gtccaacaattgaaacattt

SEQ ID NO: 15391 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
gacacttagcatactatttt

SEQ ID NO: 15392 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGATT
tatctctatggatttgtcta

SEQ ID NO: 15393 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGATT
actcatctatgttttatctc

SEQ ID NO: 15394 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
gccccttggaaaccactcat

SEQ ID NO: 15395 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
catcaccactacctaattag

SEQ ID NO: 15396 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
caattttaaagtatacaatt

SEQ ID NO: 15397 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCCGATT
agggtcttaagattcctaat

SEQ ID NO: 15398 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
ctagacaatacagaagggtc

SEQ ID NO: 15399 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGATT
ccaaatgtatttatcagaaa

SEQ ID NO: 15400 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGTTT
gtatacacattatatataca

SEQ ID NO: 15401 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAAGATT
gctgtcactgcttactaagc

SEQ ID NO: 15402 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGCTT
tatatttgtaaaagagctgt

SEQ ID NO: 15403 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
ggtttacactttttccaagt

SEQ ID NO: 15404 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGTTT
gatagtctatgcagtgccaa

SEQ ID NO: 15405 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGATT
ctcagaggtatgtgacatca

SEQ ID NO: 15406 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGATT
aataacagcaaacctctggg

SEQ ID NO: 15407 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGCTT
attgtttttgcgtaagtact

SEQ ID NO: 15408 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
aactggctggattttgtcgt

SEQ ID NO: 15409 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGATT
cttcgtgacccgtggaactg

SEQ ID NO: 15410 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGCTT
cacttgtaaaaatccttgca

SEQ ID NO: 15411 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
tctagtatcccaatggaatc

SEQ ID NO: 15412 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
taattagagaaaataagtta

SEQ ID NO: 15413 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
tattttctggatagacctat

SEQ ID NO: 15414 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGTTT
caagtacctctgctttctgg

SEQ ID NO: 15415 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
ttcttagttatttcaagtac

SEQ ID NO: 15416 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
aattatatgggtgtattttt

SEQ ID NO: 15417 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGTTT
cacatattttattcttgggt

SEQ ID NO: 15418 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
attagaaaaattagatgcta

SEQ ID NO: 15419 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGATT
ctcctctatgatattaacct

SEQ ID NO: 15420 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGCTT
tttaccttcccatgttatat

SEQ ID NO: 15421 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
aatctttaccttcccatgtt

SEQ ID NO: 15422 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
tgggtataagtacattttaa

SEQ ID NO: 15423 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGATT
ccactgtcgtctcttttgtt

SEQ ID NO: 15424 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
agactgggagagtggcaata

SEQ ID NO: 15425 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
gcaccttgaaagactctggt

SEQ ID NO: 15426 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGTTT
ccttttgcaccttgaaagac

SEQ ID NO: 15427 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
gtacactcatatccttttaa

SEQ ID NO: 15428 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
tcctctaagaagaatatcta

SEQ ID NO: 15429 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
caatgccacacctgctttat

SEQ ID NO: 15430 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCTGCTT
atcttccgtttcaatgccac

SEQ ID NO: 15431 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCCGTTT
tgaacaaagggaaaacaatc

SEQ ID NO: 15432 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGATT
ttgatgtgaaaaattgatat

SEQ ID NO: 15433 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
acattgctggagtctgatgg

SEQ ID NO: 15434 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
ttagagatagctagtttcta

SEQ ID NO: 15435 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGTTT
tgataaaaatattagagata

SEQ ID NO: 15436 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGTTT
ccagcaagtattaaaattct

SEQ ID NO: 15437 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGATT
gaaattgaactcagtgattg

SEQ ID NO: 15438 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
taaaataaagaaattgaact

SEQ ID NO: 15439 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATCGTTT
agaatgtttgcttctattca

SEQ ID NO: 15440 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGCTT
tacaataacatttcaagaat

SEQ ID NO: 15441 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
tggctacaataacatttcaa

SEQ ID NO: 15442 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
aatattttgttgttactgct

SEQ ID NO: 15443 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGCTT
atttctaagccaatgcttta

SEQ ID NO: 15444 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGCTT
tgtctttctgatttctaagc

SEQ ID NO: 15445 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
ctgggatttgaactttgtct

SEQ ID NO: 15446 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
ccaaccggagaaaaataagg

SEQ ID NO: 15447 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
tacctcctgaatacggtgag

SEQ ID NO: 15448 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
cctgaaaacaatagactctg

SEQ ID NO: 15449 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGATT
ggacacctgaaaacaataga

SEQ ID NO: 15450 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
tctactgagatttaagacaa

SEQ ID NO: 15451 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
ttttttaaaaatacagtcta

SEQ ID NO: 15452 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
cgtggggattacaattcaaa

SEQ ID NO: 15453 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGATT
caggtccctcccctgagacg

SEQ ID NO: 15454 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGATT
actgggtaatttataaagaa

SEQ ID NO: 15455 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGGGATT
ttttgtatttttagtagaga

SEQ ID NO: 15456 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ccgccaccacacctggctaa

SEQ ID NO: 15457 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCGCGATT
gcccaggctggagtgccgtg

SEQ ID NO: 15458 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
cttttcattacctgttatga

SEQ ID NO: 15459 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCGGTTT
tcatgttagctcagatgacc

SEQ ID NO: 15460 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
tgccaatactatgtagtatg

SEQ ID NO: 15461 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
tgcagacccaaaaatcactt

SEQ ID NO: 15462 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
tagtatacattgtttagtat

SEQ ID NO: 15463 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
gtttagtataacatagtata

SEQ ID NO: 15464 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
agcaattgtgaaatttagta

SEQ ID NO: 15465 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGATT
gtccttcacatcccttgtaa

SEQ ID NO: 15466 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
cctcttttatttccttgagc

SEQ ID NO: 15467 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tgagcatggaatgttcttcc

SEQ ID NO: 15468 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
cagtatggccattttcacga

SEQ ID NO: 15469 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGCTT
gttctgtgaagaaagtcatt

SEQ ID NO: 15470 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
tggttccatatgaactttaa

SEQ ID NO: 15471 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
tccagctttgttcttttggc

SEQ ID NO: 15472 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
gatgcctccagctttgttct

SEQ ID NO: 15473 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
aagtcaggtagcgtgatgcc

SEQ ID NO: 15474 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
gggttactgtagccttgtag

SEQ ID NO: 15475 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
ctgttttggtaccagtacca

SEQ ID NO: 15476 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
tctgttccattgatctatat

SEQ ID NO: 15477 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGTTT
ttccccattgcttgtttttc

SEQ ID NO: 15478 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
tagggaatcctttccccatt

SEQ ID NO: 15479 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
taaatagggaatcctttccc

SEQ ID NO: 15480 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGTTT
cagctttctacatatggcta

SEQ ID NO: 15481 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGCTT
gtgtaaggaagggatccagt

SEQ ID NO: 15482 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
tataaggtgtaaggaaggga

SEQ ID NO: 15483 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
taagtctttaatccatcttg

SEQ ID NO: 15484 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ggtttttatggttttaggtc

SEQ ID NO: 15485 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGTTT
gggttttcttctagggtttt

SEQ ID NO: 15486 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGTTT
gtaatgcctgggttttcttc

SEQ ID NO: 15487 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
tatgtcctgaatggtaatgc

SEQ ID NO: 15488 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
tcttttgttgccattgcttt

SEQ ID NO: 15489 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
tcaattttgtcttttgttgc

SEQ ID NO: 15490 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
attttgctgtgcagaagctc

SEQ ID NO: 15491 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGTTT
ggttgcatgttcactctgat

SEQ ID NO: 15492 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
gtaaatttgtttgagttcat

SEQ ID NO: 15493 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tgtttgtttttttcttgtaa

SEQ ID NO: 15494 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
gcccactttttgatggggtt

SEQ ID NO: 15495 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
ctttgcccactttttgatgg

SEQ ID NO: 15496 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
gtgatgatgagcattttttc

SEQ ID NO: 15497 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
gagatggtatctcattgtgg

SEQ ID NO: 15498 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
ggtgtgagatggtatctcat

SEQ ID NO: 15499 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
cctgttgtttcctgactttt

SEQ ID NO: 15500 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
tccacatcctctccagcacc

SEQ ID NO: 15501 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGTTT
ctgacttccacaatggttga

SEQ ID NO: 15502 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
gtgcatgtgtctttatagca

SEQ ID NO: 15503 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
tggacatttgggttggttcc

SEQ ID NO: 15504 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
ttgtgatagtttactgagaa

SEQ ID NO: 15505 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
gtttggttttttattcttgt

SEQ ID NO: 15506 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
atgagtgagaatatgcggtg

SEQ ID NO: 15507 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGTGTTT
cacctatgagtgagaatatg

SEQ ID NO: 15508 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGATT
atattccccttcctgtgtcc

SEQ ID NO: 15509 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
tttttttttttaattatact

SEQ ID NO: 15510 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGATT
tgtataaaaattattttaaa

SEQ ID NO: 15511 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGCTT
gacttcagtggtcagtttct

SEQ ID NO: 15512 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGTTT
agtttattttgacttcagtg

SEQ ID NO: 15513 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGTTT
cctactatgcagacaaaaag

SEQ ID NO: 15514 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGCTT
tgttgcctcccccaggacct

SEQ ID NO: 15515 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
aaatagttaagtctttattt

SEQ ID NO: 15516 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
aatctgtttatgttgttatt

SEQ ID NO: 15517 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGTTT
ttttgtagttgaaactaaaa

SEQ ID NO: 15518 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
cagaggatttagaatattac

SEQ ID NO: 15519 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
aacattgttgaagtgacagc

SEQ ID NO: 15520 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
tctgattgataagcaaagaa

SEQ ID NO: 15521 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
ttgaatggatgaggagttgc

SEQ ID NO: 15522 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
ggtaacttgaatggatgagg

SEQ ID NO: 15523 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGTTT
aactctcatggatgactatg

SEQ ID NO: 15524 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGATT
attaataggaaattggaatg

SEQ ID NO: 15525 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
tctagatgttattagaacat

SEQ ID NO: 15526 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
gtaaattgaaaatcttctgg

SEQ ID NO: 15527 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
aagactatagctgccataga

SEQ ID NO: 15528 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
ttatagctcaggaaaaaaaa

SEQ ID NO: 15529 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGTTT
caaagcctggatgacagcac

SEQ ID NO: 15530 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
gagaagtcaatgtctggctt

SEQ ID NO: 15531 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGCTT
ctagaaaggagaagtcaatg

SEQ ID NO: 15532 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGATT
taagagtggttacattaaac

SEQ ID NO: 15533 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
aagctggcagacggtacccc

SEQ ID NO: 15534 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
aggtgaagaagctggaaaaa

SEQ ID NO: 15535 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
agccttattgcaaatataga

SEQ ID NO: 15536 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGCTT
aaatcagaagctagaaatga

SEQ ID NO: 15537 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
cactttaaatcagaagctag

SEQ ID NO: 15538 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGCTT
ccctatctctctccctttcc

SEQ ID NO: 15539 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
caatcattaaatgtgacgtg

SEQ ID NO: 15540 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
atctttgttgttactgtggt

SEQ ID NO: 15541 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGTTT
tactgcattctttacaagtt

SEQ ID NO: 15542 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGCTT
tacaggcatacttcatttta

SEQ ID NO: 15543 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
ttaaaaacctttatcctaac

SEQ ID NO: 15544 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
gtaaacgttcttgtgtggac

SEQ ID NO: 15545 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
ttcattggtgagtaatgagg

SEQ ID NO: 15546 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
tttattgctaaatactaatt

SEQ ID NO: 15547 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
gtaacatgtacctatacttc

SEQ ID NO: 15548 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGGGTTT
tttggctctgtgttctttca

SEQ ID NO: 15549 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGATT
aatactctacattttgtttc

SEQ ID NO: 15550 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ctgacaaaaaatactctaca

SEQ ID NO: 15551 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
gtatgcaacaatcatcatta

SEQ ID NO: 15552 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTGGTTT
cattttaaagtgtatcactc

SEQ ID NO: 15553 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
aattcttaatgcatattcat

SEQ ID NO: 15554 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
gaggacaattttcacatatt

SEQ ID NO: 15555 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
tgctttgatttgattcattg

SEQ ID NO: 15556 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
gcaactgctttgatttgatt

SEQ ID NO: 15557 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
cacaagtggcaactgctttg

SEQ ID NO: 15558 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
caaagcacaagtggcaactg

SEQ ID NO: 15559 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGCTT
atctccaaagcacaagtggc

SEQ ID NO: 15560 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
gttatcccgtcttctcacct

SEQ ID NO: 15561 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGATT
gagttcacaacatctttgta

SEQ ID NO: 15562 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
tagcattgaccaccctttgc

SEQ ID NO: 15563 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
tgcttagtgtcttcctttaa

SEQ ID NO: 15564 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGCTT
cacagatcatgatgttaagc

SEQ ID NO: 15565 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGTTT
ataaaattagtaaaatgaaa

SEQ ID NO: 15566 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGTTT
gactaatgaaaactcctgtg

SEQ ID NO: 15567 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGCTT
tttcacttttattagaatgt

SEQ ID NO: 15568 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
attcattttcacttttatta

SEQ ID NO: 15569 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGCTT
tttcgattttgcctttggtg

SEQ ID NO: 15570 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTCGATT
aatctagcattctttatctt

SEQ ID NO: 15571 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
ttttaaaaaccttcattgtt

SEQ ID NO: 15572 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
ccatttgtatttttagataa

SEQ ID NO: 15573 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
gtgaggtttgacatggttac

SEQ ID NO: 15574 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGTTT
tttgtttctttgattactag

SEQ ID NO: 15575 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
gtttattttaatatttgttt

SEQ ID NO: 15576 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
ttccccatgtttattttaat

SEQ ID NO: 15577 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
aataggccaaatttggttcc

SEQ ID NO: 15578 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
acttttgttaaaatctttgc

SEQ ID NO: 15579 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGATT
actttcatccagacaggcaa

SEQ ID NO: 15580 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctgggcctcccaaagtt

SEQ ID NO: 15581 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGTTT
ttttgtacttttagtagaga

SEQ ID NO: 15582 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
atattacaaaattaccctca

SEQ ID NO: 15583 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGCTT
tataaacgaattcacgtgtt

SEQ ID NO: 15584 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGTGTTT
ttggcaatataaacgaattc

SEQ ID NO: 15585 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
ttatacatgttagaggacac

SEQ ID NO: 15586 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGATT
cccttactgttaggattttg

SEQ ID NO: 15587 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGATT
gtaacccttactgttaggat

SEQ ID NO: 15588 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGATT
atttagtgtaacccttactg

SEQ ID NO: 15589 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGATT
acatctatctgtgtgtataa

SEQ ID NO: 15590 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
aaattaggtcaaataatttt

SEQ ID NO: 15591 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGATT
acatgacaagaataaatatt

SEQ ID NO: 15592 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
ttaaacatgacaagaataaa

SEQ ID NO: 15593 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
tactgcctttatatgcaaca

SEQ ID NO: 15594 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
ttgcctaagtattctctaat

SEQ ID NO: 15595 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
gttcagaataaatatttcca

SEQ ID NO: 15596 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
tttcatgaactgggagctga

SEQ ID NO: 15597 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
aacatttcgccactgtacat

SEQ ID NO: 15598 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGTTT
gataactttttttgtcttcc

SEQ ID NO: 15599 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
atctcctcactagggtaatc

SEQ ID NO: 15600 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGCTT
tgagtgttctagactgtagc

SEQ ID NO: 15601 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGCTT
ctcagatgagtgttctagac

SEQ ID NO: 15602 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGTTT
aataatccatggattaatca

SEQ ID NO: 15603 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGATT
acattattgaataaataatc

SEQ ID NO: 15604 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
acatagagagggaagtggga

SEQ ID NO: 15605 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGCTT
gcagatattatccttttggt

SEQ ID NO: 15606 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGTTT
ttgcatctgtctttatacag

SEQ ID NO: 15607 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAGGTTT
aaaggccaggttggtgttgg

SEQ ID NO: 15608 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
ttcatcttagtctttcaatt

SEQ ID NO: 15609 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
gcttttttttttctaaagtt

SEQ ID NO: 15610 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGCTT
acttctcaatatcccacaat

SEQ ID NO: 15611 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
tttaacttctcaatatccca

SEQ ID NO: 15612 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
cctttacccagaattgatgt

SEQ ID NO: 15613 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
gcaagcattctactgaaatt

SEQ ID NO: 15614 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAACGTTT
atcacatagatcaaggtata

SEQ ID NO: 15615 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAAGTTT
catggattattctgtatctt

SEQ ID NO: 15616 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGATT
ttgagactaatgtcgaacaa

SEQ ID NO: 15617 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
tggtgaattttctgccatta

SEQ ID NO: 15618 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
aattgatcttcttttgtact

SEQ ID NO: 15619 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
atttttggaagattataaaa

SEQ ID NO: 15620 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGATT
tagttagttatcttattttt

SEQ ID NO: 15621 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
ttctctcatcacactgaaag

SEQ ID NO: 15622 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
ataggttgtctgataataga

SEQ ID NO: 15623 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ttcttatacctagaaatata

SEQ ID NO: 15624 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
tgtgaaacatcttgtattct

SEQ ID NO: 15625 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
gttctaaagaaacaaattcc

SEQ ID NO: 15626 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
caagttcatgcctcattttg

SEQ ID NO: 15627 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
atcaaactcaagtggatcct

SEQ ID NO: 15628 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGTTT
tttcattttaaaacaagtaa

SEQ ID NO: 15629 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
tggtaattggcacatttgtg

SEQ ID NO: 15630 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
taattgtacttacattttat

SEQ ID NO: 15631 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGATT
atttctaagtaattctatgg

SEQ ID NO: 15632 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
cattctcaaattccaagcag

SEQ ID NO: 15633 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ttttatttcatcaacttatg

SEQ ID NO: 15634 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
ttcctttttatctctaaata

SEQ ID NO: 15635 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
cacttcccgcttttttaaaa

SEQ ID NO: 15636 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCCGCTT
ttatctagggaataatcact

SEQ ID NO: 15637 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
tggtaactaattcaaacaat

SEQ ID NO: 15638 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGCTT
tataatatcttcttttattt

SEQ ID NO: 15639 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTGGTTT
ttctacttaagcagctgttt

SEQ ID NO: 15640 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGTTT
agaacagtttctacttaagc

SEQ ID NO: 15641 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
aagcccagtgaaggtaacag

SEQ ID NO: 15642 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
aaataatgtatctaaatata

SEQ ID NO: 15643 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGTTT
acaatctttactgtaacttt

SEQ ID NO: 15644 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGATT
agaattggtgtcagataata

SEQ ID NO: 15645 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGATT
acattacctaacataagtga

SEQ ID NO: 15646 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
tgtatttttttaggttacac

SEQ ID NO: 15647 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGCTT
tttatgctttttaaaagtag

SEQ ID NO: 15648 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGCTT
ggagggttcacgttagtatt

SEQ ID NO: 15649 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
tatgtgtactcatctgatat

SEQ ID NO: 15650 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
cctggtctattgaatggaat

SEQ ID NO: 15651 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
gttcttgaactcctgccctc

SEQ ID NO: 15652 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGATT
tgtgttgtttctattgaatt

SEQ ID NO: 15653 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
gactcggagttcaaaatatg

SEQ ID NO: 15654 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
ttcaacttccatttttttca

SEQ ID NO: 15655 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
aaaaacttttttttaccctt

SEQ ID NO: 15656 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGCTT
agtgatataagtgacatgaa

SEQ ID NO: 15657 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
ttaccaaaaaaaaaaaaaaa

SEQ ID NO: 15658 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
ctgaggatgctttagagctg

SEQ ID NO: 15659 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGCTT
cttgacaacagattgactga

SEQ ID NO: 15660 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGATT
cttcttgcttattgcttgac

SEQ ID NO: 15661 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
agttcttccttcttcttgct

SEQ ID NO: 15662 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGCTT
catcaagagttcttccttct

SEQ ID NO: 15663 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
taggaaagacctaatgtaac

SEQ ID NO: 15664 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGCGTTT
attcctgaaagttggaagat

SEQ ID NO: 15665 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
ttaaaaaagtgttttctaag

SEQ ID NO: 15666 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
aaatgaaattttttttaaaa

SEQ ID NO: 15667 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
atggaaatcgagctgtatat

SEQ ID NO: 15668 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGATT
tatatattgtaactgttgct

SEQ ID NO: 15669 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
aattgtaatgggaaaggcca

SEQ ID NO: 15670 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
aatctaaaccactcttcgga

SEQ ID NO: 15671 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
acatgctcatatgaaatgtt

SEQ ID NO: 15672 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
taatattacatgctcatatg

SEQ ID NO: 15673 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGTTT
ctcactactctaaactaaat

SEQ ID NO: 15674 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAGGCTT
gtgaatccagtattcaaaac

SEQ ID NO: 15675 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
aacatttttagaatcagaaa

SEQ ID NO: 15676 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGTTT
tcattctagggatactcttg

SEQ ID NO: 15677 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
taaaccaagtgttggaattt

SEQ ID NO: 15678 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
agattacattaatgatattt

SEQ ID NO: 15679 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGATT
gatcattcttgtattctgtt

SEQ ID NO: 15680 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGCTT
ctggagagactgtaatattt

SEQ ID NO: 15681 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACCGTTT
ccaatatttgacttcaagaa

SEQ ID NO: 15682 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
ccccaaataattttcctgat

SEQ ID NO: 15683 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGTTT
ctatagattttccctatgtg

SEQ ID NO: 15684 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
acccacttcccacctcatcc

SEQ ID NO: 15685 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
gtttacttcagtgatttttt

SEQ ID NO: 15686 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGATT
attagtgttggtgtttactt

SEQ ID NO: 15687 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
tattaggtaaaaattagtgt

SEQ ID NO: 15688 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCAGTTT
ctaataaatcatttgggaac

SEQ ID NO: 15689 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGCTT
aacttattctcttaaataaa

SEQ ID NO: 15690 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
aaaagttatcaaaggaaaca

SEQ ID NO: 15691 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGCTT
gaaacaaacaagtaaacact

SEQ ID NO: 15692 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGATT
tcatatcatagtccctctaa

SEQ ID NO: 15693 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
attgttgtaattttatcgaa

SEQ ID NO: 15694 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGATT
tgcctcagcctcctgagtag

SEQ ID NO: 15695 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
cagattttggcagatcttcc

SEQ ID NO: 15696 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
tttatactgactcaatctca

SEQ ID NO: 15697 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
acctgcaggaaaaaatcact

SEQ ID NO: 15698 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAAGATT
aaaaattaatggtacttcag

SEQ ID NO: 15699 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGCTT
ctgattctatggtgccttga

SEQ ID NO: 15700 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGATT
aaactttttaggttctcatg

SEQ ID NO: 15701 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
gttatcgttgttgatgttaa

SEQ ID NO: 15702 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGTTT
ctcatggttagattaaggct

SEQ ID NO: 15703 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTAGATT
tgtctgatatttttctcatg

SEQ ID NO: 15704 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
gtcgcaatttctcaggcttt

SEQ ID NO: 15705 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGCTT
ctctaggctgtcgcaatttc

SEQ ID NO: 15706 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
ccttaccctattcagagttc

SEQ ID NO: 15707 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
atccagtttcccctgttatt

SEQ ID NO: 15708 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
cagtttcaatataccccaca

SEQ ID NO: 15709 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGTTT
aaaatggtgcagatagtaag

SEQ ID NO: 15710 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGATT
tgcttaaacttttgtcttgg

SEQ ID NO: 15711 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
attctacatctgtgatttcc

SEQ ID NO: 15712 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
atattagaataattctacat

SEQ ID NO: 15713 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGATT
atagaaaattatcctcccag

SEQ ID NO: 15714 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
attgtgactccagtttagtt

SEQ ID NO: 15715 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
taggactcagacattgtgac

SEQ ID NO: 15716 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
ttattctaaaagaaaataca

SEQ ID NO: 15717 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGCTT
aacaacttaaaagatattta

SEQ ID NO: 15718 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGCTT
tcattaagatggatatgtaa

SEQ ID NO: 15719 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGGGCTT
tttaaaatattattgacaaa

SEQ ID NO: 15720 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
tcagatccatctggaaattt

SEQ ID NO: 15721 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
cttggtgccaagacatagaa

SEQ ID NO: 15722 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGCTT
ttcttattgtctttgaatgt

SEQ ID NO: 15723 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
ttgtacttcttattgtcttt

SEQ ID NO: 15724 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATCGTTT
cccctgtattctccagattc

SEQ ID NO: 15725 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGATT
attatttttcccctgtattc

SEQ ID NO: 15726 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGTTT
cacataggaatggatataga

SEQ ID NO: 15727 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
tccaaagatgttatcaggta

SEQ ID NO: 15728 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGATT
aaatgctgtagacatcctgc

SEQ ID NO: 15729 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGCTT
atttattcttgacacaaaat

SEQ ID NO: 15730 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAAGCTT
atggtaagatcatcatatat

SEQ ID NO: 15731 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGCTT
tcagaaaagttcacaataac

SEQ ID NO: 15732 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGCTT
actagtgattaatatatgac

SEQ ID NO: 15733 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
agtgcaggatttccaaacac

SEQ ID NO: 15734 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGATT
ggatgttatttaagcaaagt

SEQ ID NO: 15735 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGGGTTT
gaaaatgaaaagttttgtca

SEQ ID NO: 15736 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
aattctcaagacagaaaatg

SEQ ID NO: 15737 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
tataaacgcaatattaaata

SEQ ID NO: 15738 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
gcaacagagtgagtgagacc

SEQ ID NO: 15739 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTCGCTT
agctacttgggaaggtggga

SEQ ID NO: 15740 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
tgagaccttgtctctacaaa

SEQ ID NO: 15741 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
taaatataataaattacaac

SEQ ID NO: 15742 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
gtttttactctacttaagtg

SEQ ID NO: 15743 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
cataatggctggctcaattc

SEQ ID NO: 15744 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
gtagtgaggaaagaggattg

SEQ ID NO: 15745 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
tgaggtgttgtagtgaggaa

SEQ ID NO: 15746 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
ttatttctaataagattata

SEQ ID NO: 15747 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
tatttgactgtttatttcta

SEQ ID NO: 15748 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGTTT
gataagattatattatattt

SEQ ID NO: 15749 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
tgaagatgggcagtcaattg

SEQ ID NO: 15750 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAGGATT
aggctaaagatacactgctt

SEQ ID NO: 15751 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGCTT
aatgttacaggctaaagata

SEQ ID NO: 15752 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
gctacaaaaccaaatgacag

SEQ ID NO: 15753 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
aaatgcatatatcctaaaaa

SEQ ID NO: 15754 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
gtaaaacaaacccccatgac

SEQ ID NO: 15755 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTCGCTT
taaaaatgcatatatcatgt

SEQ ID NO: 15756 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
caacttgagttttcagaaaa

SEQ ID NO: 15757 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
caatgattaattctctcaac

SEQ ID NO: 15758 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
ctttagtgtatattttagta

SEQ ID NO: 15759 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
ctaatattcttcatttcttg

SEQ ID NO: 15760 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
aaaccataaaacataaacct

SEQ ID NO: 15761 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
acttaatgcattttaaccta

SEQ ID NO: 15762 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGATT
tttcatatacaaataatggt

SEQ ID NO: 15763 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGTTT
tcaaaataagattaaagaaa

SEQ ID NO: 15764 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
taaaataattgaaagtcaaa

SEQ ID NO: 15765 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
acattaagggaattcatgga

SEQ ID NO: 15766 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATCGCTT
attgatggctggtcacttaa

SEQ ID NO: 15767 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
atttttttactttaatcttt

SEQ ID NO: 15768 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
taaaatcaagactaccttca

SEQ ID NO: 15769 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGTTT
tgtgttgtaattgtttacct

SEQ ID NO: 15770 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
tcatatagtaggtgtgttgt

SEQ ID NO: 15771 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
aagccaaagatgattttttt

SEQ ID NO: 15772 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
ccatcgaaggacaaagccaa

SEQ ID NO: 15773 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGTTT
gtacaggaatagaaaatcta

SEQ ID NO: 15774 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
cctttaaaatttttaattag

SEQ ID NO: 15775 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGCTT
atttaacctttagaaggaaa

SEQ ID NO: 15776 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
ttatccacaatacaagtaag

SEQ ID NO: 15777 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGCTT
gagaaaaaatattaataaaa

SEQ ID NO: 15778 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGATT
atgagaaaatgtatgtaaat

SEQ ID NO: 15779 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGCTT
atgctaagtactttaaatca

SEQ ID NO: 15780 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCAGATT
tattatgcagtagttagaag

SEQ ID NO: 15781 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTGGATT
ttccaagaaggttggggact

SEQ ID NO: 15782 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
tgcctgatcatctgaagtgg

SEQ ID NO: 15783 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGCTT
cattagactctcagagaagt

SEQ ID NO: 15784 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGGGTTT
aggccacagtgggttagatc

SEQ ID NO: 15785 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGTTT
cacagatccataaaacctgg

SEQ ID NO: 15786 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGCTT
gtcgatttagagtatataag

SEQ ID NO: 15787 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
gtgttgtcgatttagagtat

SEQ ID NO: 15788 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTCGATT
ataacagagtggttgggtgt

SEQ ID NO: 15789 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
attcttggattgtgtaataa

SEQ ID NO: 15790 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
atagcactattaaataaatt

SEQ ID NO: 15791 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
cattgagcaatgaactataa

SEQ ID NO: 15792 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGATT
ctgttcattctagataagaa

SEQ ID NO: 15793 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
aatatagtcactttagtcac

SEQ ID NO: 15794 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGCTT
gggcaacagaatccatttga

SEQ ID NO: 15795 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
ttcaataaaatcttccttta

SEQ ID NO: 15796 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGATT
ctactggtcactgctgccac

SEQ ID NO: 15797 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCTGTTT
tgacaaaagggaaatctaga

SEQ ID NO: 15798 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGCTT
gggtactcatgcattcattg

SEQ ID NO: 15799 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGATT
actggctgtcccaagccaaa

SEQ ID NO: 15800 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
tttctcatattaagcaaaga

SEQ ID NO: 15801 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
aactgtcatagccaaaagga

SEQ ID NO: 15802 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGCTT
gcaaaactgtcatagccaaa

SEQ ID NO: 15803 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
attttcaagtgattcagaag

SEQ ID NO: 15804 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
aggtcaagtgattaattttc

SEQ ID NO: 15805 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
aaatcactacttctgaggtc

SEQ ID NO: 15806 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
ttctgcatttacagactgca

SEQ ID NO: 15807 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGATT
tatgataggaacaatattga

SEQ ID NO: 15808 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
ggacggacttagtccaaaat

SEQ ID NO: 15809 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
tggttttgttatatttacat

SEQ ID NO: 15810 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGTTT
cctgcaagattaaataatgg

SEQ ID NO: 15811 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGCTT
atggtcctgcaagattaaat

SEQ ID NO: 15812 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGATT
tatggaaggcttatggtcct

SEQ ID NO: 15813 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGCTT
gcatcatcaggttgcttatg

SEQ ID NO: 15814 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGCTT
gtagtaagttagcatcatca

SEQ ID NO: 15815 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
aatattttagagtattgaaa

SEQ ID NO: 15816 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
ttaaaatattttagagtatt

SEQ ID NO: 15817 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
tttcttaaaataaatatatt

SEQ ID NO: 15818 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGTTT
gaattatcctgttgaggacc

SEQ ID NO: 15819 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
agataaacaattagtaaatt

SEQ ID NO: 15820 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGCTT
tgttacattgtagggggaac

SEQ ID NO: 15821 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
agtcaatacatgttcagaag

SEQ ID NO: 15822 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
aataaaaattcatgacaatg

SEQ ID NO: 15823 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCTGTTT
gtttatcccttgtatgccaa

SEQ ID NO: 15824 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
tattaaagataaaatggatg

SEQ ID NO: 15825 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
cattgttaattgatgccctc

SEQ ID NO: 15826 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGATT
gcattccatatcttttagca

SEQ ID NO: 15827 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
tagatgcagttgagagaatt

SEQ ID NO: 15828 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
aagaaattgttgcagagacc

SEQ ID NO: 15829 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGCTT
aataattttctcataaaaag

SEQ ID NO: 15830 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tacagagattaccacagctc

SEQ ID NO: 15831 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGATT
aataactccatttactgtta

SEQ ID NO: 15832 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGTTT
cttccactttgtatatcata

SEQ ID NO: 15833 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGATT
taacagctaagcaaatagat

SEQ ID NO: 15834 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
aagctctttgtgcagcatac

SEQ ID NO: 15835 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAAGTTT
tcaaaaatgtcaaaatgcaa

SEQ ID NO: 15836 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGATT
tgactgacagtgacaaagct

SEQ ID NO: 15837 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
actcttgtttatgtttagtt

SEQ ID NO: 15838 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
ttcattggctcaactcttgt

SEQ ID NO: 15839 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
aatcctttcattggctcaac

SEQ ID NO: 15840 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
gttcaatttactgtaagttc

SEQ ID NO: 15841 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
tcttgctggcaaacagaacg

SEQ ID NO: 15842 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAACGTTT
ttctctcttgctggcaaaca

SEQ ID NO: 15843 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGCTT
aaaccttatataatgtcagc

SEQ ID NO: 15844 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
taagtgtcccactctagtga

SEQ ID NO: 15845 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGCTT
gttagcaagtgaaggccagt

SEQ ID NO: 15846 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGCTT
taactgcctcactccagtaa

SEQ ID NO: 15847 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
tgaaattctcattccagtgg

SEQ ID NO: 15848 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAAGTTT
gaaaagaatggtctttaagc

SEQ ID NO: 15849 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGCTT
aaactctgtacatgctcaga

SEQ ID NO: 15850 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTAGATT
accgtatactttaaatcatc

SEQ ID NO: 15851 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGGGATT
aattgtccctcagtatcagt

SEQ ID NO: 15852 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGTTT
caatccctatcctctttcta

SEQ ID NO: 15853 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ttaaatgccaacattagcca

SEQ ID NO: 15854 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATCGCTT
gcgacagtaattggtgatta

SEQ ID NO: 15855 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGATT
catttttctgcgacagtaat

SEQ ID NO: 15856 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGCTT
acagcctaaatttcctgtat

SEQ ID NO: 15857 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGCTT
gattttgtcctgcacccttt

SEQ ID NO: 15858 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
atgaaactaggaaatgtatg

SEQ ID NO: 15859 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATCGATT
aggtttctcaacctcagctt

SEQ ID NO: 15860 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGCTT
ctaagcataggtttctcaac

SEQ ID NO: 15861 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
ggtgaaattgtggtctaagc

SEQ ID NO: 15862 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGCCGTTT
aaaacccagccagcctctca

SEQ ID NO: 15863 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
tgattacaactgaaaacagt

SEQ ID NO: 15864 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGATT
ttaatcactggatgacactg

SEQ ID NO: 15865 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGCTT
ataaaaggagtaccaaagct

SEQ ID NO: 15866 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
gtgtactataaaaggagtac

SEQ ID NO: 15867 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGCTT
aaatatggacttgatcattt

SEQ ID NO: 15868 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGTTT
ccctctagactatgtgaaaa

SEQ ID NO: 15869 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGTTT
tccatacccccaccaatcat

SEQ ID NO: 15870 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
aaccacatacctatacctca

SEQ ID NO: 15871 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGTTT
tgttctttaagcctcatcct

SEQ ID NO: 15872 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGATT
tcaaacacaggatgtccaaa

SEQ ID NO: 15873 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
cttccattcaagctgttttg

SEQ ID NO: 15874 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGTTT
ttttaaaatacttccattca

SEQ ID NO: 15875 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
tcaaaccaatttctaacccc

SEQ ID NO: 15876 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGCTT
ctggattaaaaagaaggtag

SEQ ID NO: 15877 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGATT
ctagcttttcagtgttggag

SEQ ID NO: 15878 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGCTT
aagtaacttaactaaggtga

SEQ ID NO: 15879 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGTTT
ttggttcaagtatgattcta

SEQ ID NO: 15880 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGATT
ttgagttcttattggttcaa

SEQ ID NO: 15881 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCAGTTT
acattttgaagcatttatgt

SEQ ID NO: 15882 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGTTT
ctactcctccgtttgaaagc

SEQ ID NO: 15883 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCCGTTT
gagaatgcctggcactactc

SEQ ID NO: 15884 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGATT
tgcatagatatgctttgctg

SEQ ID NO: 15885 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
atctccttgtatttgcatag

SEQ ID NO: 15886 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGTTT
aacaaatagcataagtatag

SEQ ID NO: 15887 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
tatcatactggtgttaattt

SEQ ID NO: 15888 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAAGATT
taaaaaatgatgtaatttaa

SEQ ID NO: 15889 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGATT
tgagacgcattctacaaaat

SEQ ID NO: 15890 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
tctaattccatagataacgc

SEQ ID NO: 15891 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAACGCTT
aaagtatctaattccataga

SEQ ID NO: 15892 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
agccatgtatttctgcattt

SEQ ID NO: 15893 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACTGATT
agtttaccagataaactact

SEQ ID NO: 15894 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGTTT
ttgttttatttaattacaag

SEQ ID NO: 15895 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
ttttcaattaacttcctggg

SEQ ID NO: 15896 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGATT
gcttttttcaattaacttcc

SEQ ID NO: 15897 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGCTT
cttctaggtgttcctgatgg

SEQ ID NO: 15898 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTGGCTT
gcttaaacagaccaacaaag

SEQ ID NO: 15899 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
gaagagcagtgtgccagaaa

SEQ ID NO: 15900 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
caacttacctgtcattttaa

SEQ ID NO: 15901 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGTTT
atatcagagagtcagctatt

SEQ ID NO: 15902 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
tgcatgtctttccccaggca

SEQ ID NO: 15903 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
gtttttgttaatttaaatat

SEQ ID NO: 15904 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGTTT
cttgttcaggtgccagggac

SEQ ID NO: 15905 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGTTT
atttacaagtaattaacaaa

SEQ ID NO: 15906 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGATT
agaagttatttaatttaaaa

SEQ ID NO: 15907 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGCTT
ctgtagagtaaaccctagcc

SEQ ID NO: 15908 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
tcccatttgttttctctttt

SEQ ID NO: 15909 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
attaaggagactggtttccc

SEQ ID NO: 15910 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTGGTTT
cactcattttcattaaggag

SEQ ID NO: 15911 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGCTT
tcttcccaagatgtgttatt

SEQ ID NO: 15912 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
gtcaaatagtcgatataaat

SEQ ID NO: 15913 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGTTT
gatatgtcaatgttaaaatg

SEQ ID NO: 15914 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGTTT
gaaagtaaaactgagtgaaa

SEQ ID NO: 15915 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGATT
ctaagtcttaacgattagaa

SEQ ID NO: 15916 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAACGATT
atgattagaggactaagtct

SEQ ID NO: 15917 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
gaaagaaagaaaacgttgtg

SEQ ID NO: 15918 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGTTT
attttccatttgttccccag

SEQ ID NO: 15919 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
ttcttgaatgtgaaatttcc

SEQ ID NO: 15920 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCAGTTT
agaaaaatgaaaggaatctt

SEQ ID NO: 15921 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
ctgacttctggtcatagctt

SEQ ID NO: 15922 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGCTT
ctcaaagcctgacttctggt

SEQ ID NO: 15923 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
ttattcacagagcagctgta

SEQ ID NO: 15924 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGTTT
gaatttattcacagagcagc

SEQ ID NO: 15925 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGCTT
tattgatgaaatgaatatgg

SEQ ID NO: 15926 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGCTT
aatgttattgatgaaatgaa

SEQ ID NO: 15927 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACAGATT
ttgtatttcctgaatgaaat

SEQ ID NO: 15928 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGCTT
gtattgacattattctgcaa

SEQ ID NO: 15929 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGCGCTT
acatacgtgctgatgtgttt

SEQ ID NO: 15930 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
tagtctatacatacgtgctg

SEQ ID NO: 15931 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAACGATT
ttaaatagcccaaagattct

SEQ ID NO: 15932 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGATT
tgtacaaactttaaatagcc

SEQ ID NO: 15933 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
ctattactgattgaagtcat

SEQ ID NO: 15934 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGATT
attgactagattggttctat

SEQ ID NO: 15935 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGATT
tctccatatggcattcattg

SEQ ID NO: 15936 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ccacactataattaaagcca

SEQ ID NO: 15937 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
taatggtttaatctttaaaa

SEQ ID NO: 15938 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGTTT
agaaaattttctctgactct

SEQ ID NO: 15939 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
tgttttacactgcatgtgta

SEQ ID NO: 15940 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
catatgttttacactgcatg

SEQ ID NO: 15941 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
ttgtgtatatttttaaatgc

SEQ ID NO: 15942 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
aaaataatgataaaataaaa

SEQ ID NO: 15943 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGATT
ttattcaagatcaaggtaat

SEQ ID NO: 15944 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
ttgtcttcattcttatcttt

SEQ ID NO: 15945 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGCTT
acacctaagaacaatgctgg

SEQ ID NO: 15946 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
tgtatgcaaagggcataatc

SEQ ID NO: 15947 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGCTT
tgtttgcctgagttctccag

SEQ ID NO: 15948 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
gaaggtagggatggacaggg

SEQ ID NO: 15949 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAACGTTT
caatgcactctatgtgctaa

SEQ ID NO: 15950 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGTTT
taatctgatgttgaaagaat

SEQ ID NO: 15951 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
gttttctttttgaaataaaa

SEQ ID NO: 15952 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
tttatatgtgaagcctttac

SEQ ID NO: 15953 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGTTT
tgtaaagtctcctaaaagct

SEQ ID NO: 15954 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
caacatatgtaaagtctcct

SEQ ID NO: 15955 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGCTT
tcctcaaaccaaaggttccc

SEQ ID NO: 15956 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGTGGTTT
cactttttcaatgaggaaac

SEQ ID NO: 15957 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
cccctcggcctcccaaagtg

SEQ ID NO: 15958 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
cattataaagcatctacata

SEQ ID NO: 15959 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGCTT
taatatgtattgagtggttc

SEQ ID NO: 15960 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGATT
aagaattgacacttagcatt

SEQ ID NO: 15961 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGATT
ttactgtaactaaagcaaag

SEQ ID NO: 15962 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGTTT
tgatgttactgtaactaaag

SEQ ID NO: 15963 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGATT
tgtctgtgctagtttagttt

SEQ ID NO: 15964 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
tttctttttgtctgtgctag

SEQ ID NO: 15965 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGTTT
gtacttttctttttgtctgt

SEQ ID NO: 15966 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGCTT
ttgatatatttttaacttta

SEQ ID NO: 15967 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGCTT
tcttttttagtagtgctatt

SEQ ID NO: 15968 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
tttcatcaaaggcttttctt

SEQ ID NO: 15969 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGCTT
tcgtaagatgctgtttcatc

SEQ ID NO: 15970 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGTTT
aagtccttagtttcgtaaga

SEQ ID NO: 15971 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
gaatgtacaaattacaagtc

SEQ ID NO: 15972 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGTTT
tataatgatgatttatagag

SEQ ID NO: 15973 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
ctgatgaattgctagtataa

SEQ ID NO: 15974 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGATT
taaaaggagcttcaaaacaa

SEQ ID NO: 15975 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGCTT
acatgaaaaggatcactaaa

SEQ ID NO: 15976 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGCTT
tgtttgcacaaaggattgta

SEQ ID NO: 15977 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
ttttctttccctgtttgcac

SEQ ID NO: 15978 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGTTT
atcttgattgttttttcttt

SEQ ID NO: 15979 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
acctcttagtttggtatctt

SEQ ID NO: 15980 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
ttccacctcttagtttggta

SEQ ID NO: 15981 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
agtgatggaaatttccacct

SEQ ID NO: 15982 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGTTT
gccttctcctcccacatatt

SEQ ID NO: 15983 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
cacatcaggggcagaggatt

SEQ ID NO: 15984 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
tgctgcttcacatcaggggc

SEQ ID NO: 15985 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
aaatgctttctgtcttacac

SEQ ID NO: 15986 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
gataacaaaggacatgattc

SEQ ID NO: 15987 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGATT
tctggcaaagataacaaagg

SEQ ID NO: 15988 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
ttccatttagttcctcgaga

SEQ ID NO: 15989 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
catgaggtctgaaatgtagt

SEQ ID NO: 15990 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGATT
tatatatgtcttgattcatt

SEQ ID NO: 15991 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGATT
aagatatatatgtcttgatt

SEQ ID NO: 15992 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
acataatcaagatatatatg

SEQ ID NO: 15993 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGATT
tcctgaagaaatcctaaaaa

SEQ ID NO: 15994 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCTGCTT
ttacatttgtagcacagggt

SEQ ID NO: 15995 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGCTT
agttttcaaaagaggcggat

SEQ ID NO: 15996 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGTTT
catactgacctcaacgtggt

SEQ ID NO: 15997 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
cctagattgtttttctggaa

SEQ ID NO: 15998 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGTTT
ctattaatttgaaatgccta

SEQ ID NO: 15999 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGATT
tcctctattaatttgaaatg

SEQ ID NO: 16000 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
ctgtttttgtttgtatgttt

SEQ ID NO: 16001 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
atatctgtttttgtttgtat

SEQ ID NO: 16002 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGTTT
aattatatctgtttttgttt

SEQ ID NO: 16003 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tttctggcaattatatctgt

SEQ ID NO: 16004 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGTTT
caggattttctggcaattat

SEQ ID NO: 16005 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGATT
aataaataccttcatcttca

SEQ ID NO: 16006 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCCGTTT
ataaaaagatatagcatagg

SEQ ID NO: 16007 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGCTT
tgtaatgcccatgtttaaac

SEQ ID NO: 16008 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCATGTTT
gaaagtgtaatgtgtaatgc

SEQ ID NO: 16009 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
tcagggaggaagctagattc

SEQ ID NO: 16010 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTAGATT
ctcccaaattcagggaggaa

SEQ ID NO: 16011 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
aaggtattcttctccatctt

SEQ ID NO: 16012 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
tcactgactcttgttttctt

SEQ ID NO: 16013 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGCTT
ggcatcactgactcttgttt

SEQ ID NO: 16014 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
agtggtagggcatcactgac

SEQ ID NO: 16015 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
ggcctatggtctttttgaga

SEQ ID NO: 16016 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
gttcactaatgagggagaag

SEQ ID NO: 16017 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCAGGCTT
ctgagataaataaaaggtat

SEQ ID NO: 16018 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
ttttctactggacagtattg

SEQ ID NO: 16019 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
ctcaagtattatgtacttta

SEQ ID NO: 16020 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGCTT
acaggagatacatatttttt

SEQ ID NO: 16021 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGTTT
tcccttaggtcactaatgtg

SEQ ID NO: 16022 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGCTT
tgcagtcccttaggtcacta

SEQ ID NO: 16023 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAAGTTT
ctgcacctgctccatattta

SEQ ID NO: 16024 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGTTT
acgctttagagagaacaatg

SEQ ID NO: 16025 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCACGCTT
agcttgattcccacctgaac

SEQ ID NO: 16026 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGATT
tatcatatacttttcaatga

SEQ ID NO: 16027 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGCTT
tatatatcatatacttttca

SEQ ID NO: 16028 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGCTT
tgtctttctgatgttcctct

SEQ ID NO: 16029 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGTTT
ctcaaaactattgtgcaaat

SEQ ID NO: 16030 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
gtgtgaggttcaaacaattt

SEQ ID NO: 16031 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
aagagtgatggaccagtgcc

SEQ ID NO: 16032 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGATT
gagcaatgattcatgaaccc

SEQ ID NO: 16033 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
tgtcaagagctttctaagag

SEQ ID NO: 16034 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGCTT
aaacctatcccctgggtgtc

SEQ ID NO: 16035 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGTGATT
ctaggcatgttgatctccca

SEQ ID NO: 16036 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGCTT
attctaaatagcacagaact

SEQ ID NO: 16037 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
ttacttcatataaagtctta

SEQ ID NO: 16038 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
ttgttttccgtgtcatcatt

SEQ ID NO: 16039 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
gtaatttagacacttcctgg

SEQ ID NO: 16040 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTGGATT
tccaggtaatttagacactt

SEQ ID NO: 16041 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTACGATT
ctgtgaagaatggggctggg

SEQ ID NO: 16042 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
ttatctggcactccgatcct

SEQ ID NO: 16043 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
ctaccatcttgccataggaa

SEQ ID NO: 16044 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
tgcctcttcctctctggagc

SEQ ID NO: 16045 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
atgttggaagactttctatt

SEQ ID NO: 16046 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGTTT
aataagagtatatgaaaaat

SEQ ID NO: 16047 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGATT
aaagtataatcaatagccct

SEQ ID NO: 16048 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGATT
agcaaagggaaagggtttag

SEQ ID NO: 16049 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGTTT
aaagagaaaaagcaaaggga

SEQ ID NO: 16050 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
ataagctattgagaagccac

SEQ ID NO: 16051 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAGGTTT
gaggtttaagaaaagtagtt

SEQ ID NO: 16052 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGTTT
ctgcacccggccactacttt

SEQ ID NO: 16053 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
cacctctgcctcccaaagtg

SEQ ID NO: 16054 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGAGTTT
tgtattttttttagtagaga

SEQ ID NO: 16055 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCGGGATT
tgcctcagccttccgaggag

SEQ ID NO: 16056 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGCGATT
caatctccgctcctgggttc

SEQ ID NO: 16057 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGAGTTT
tgtttgtttgtttgttttga

SEQ ID NO: 16058 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
gtttgtttgtttgtttgttt

SEQ ID NO: 16059 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
ttttgtttgtttgtttgttt

SEQ ID NO: 16060 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
agttttttgtttgtttgttt

SEQ ID NO: 16061 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
gaggagttttttgtttgttt

SEQ ID NO: 16062 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
atgagaggagttttttgttt

SEQ ID NO: 16063 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGTTT
catgatgagaggagtttttt

SEQ ID NO: 16064 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
aaatcatgatgagaggagtt

SEQ ID NO: 16065 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGAGTTT
ttatgtcaaatcatgatgag

SEQ ID NO: 16066 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGTGATT
gatggtcacagcttggggga

SEQ ID NO: 16067 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGCTT
agaaagatgaataagatggt

SEQ ID NO: 16068 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
tatacaactgaataagtatt

SEQ ID NO: 16069 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
tttgaactctttctcacttt

SEQ ID NO: 16070 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGATT
aaaatgaagtggaagtacac

SEQ ID NO: 16071 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGATT
acctaatttaaaagtttgta

SEQ ID NO: 16072 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
ggaatattgtgacctaattt

SEQ ID NO: 16073 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGTTT
cattgcccttatagtctact

SEQ ID NO: 16074 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctcggccttccaaagtg

SEQ ID NO: 16075 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGTTT
ttttgtatttttagtagaga

SEQ ID NO: 16076 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctcagcctcctgagtag

SEQ ID NO: 16077 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGAGTTT
tttttattttttttgtgaga

SEQ ID NO: 16078 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
agtccacgaaccaggagtag

SEQ ID NO: 16079 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
gttgaaagcagtcattttgt

SEQ ID NO: 16080 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
ataatctctctccttacata

SEQ ID NO: 16081 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGTTT
aattcctggaggggcatccc

SEQ ID NO: 16082 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTAGTTT
ctgaggcacatatagggata

SEQ ID NO: 16083 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
aactataattttgttgtgtt

SEQ ID NO: 16084 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
gaccagcaactataattttg

SEQ ID NO: 16085 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
atagttaaataaataatagg

SEQ ID NO: 16086 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
ggcaagatgattgacagaga

SEQ ID NO: 16087 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGATT
ctggtgatcaccagtgggca

SEQ ID NO: 16088 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGCTT
atatacttaaaatgttcttt

SEQ ID NO: 16089 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
tactcttagttataaccatc

SEQ ID NO: 16090 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
atatttgtagttgaaataat

SEQ ID NO: 16091 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTCGCTT
aaagtcaccgtcaaaatagc

SEQ ID NO: 16092 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
aaaagctttttttgttaaaa

SEQ ID NO: 16093 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
aattactcttagcactctga

SEQ ID NO: 16094 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGCTT
gtgtatgtctgtgtgtgcgt

SEQ ID NO: 16095 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGATT
ggaagcctttgtgtcgccaa

SEQ ID NO: 16096 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGCTT
tattcttctttttaggcttt

SEQ ID NO: 16097 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGCTT
gttttgtattattcttcttt

SEQ ID NO: 16098 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
caccaccctgatgtgtgggt

SEQ ID NO: 16099 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGTTT
tcatttcaccaccctgatgt

SEQ ID NO: 16100 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
gttgataaactttataagga

SEQ ID NO: 16101 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
atcttttgcttgaaaaagaa

SEQ ID NO: 16102 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
cttaccacatgacccacatc

SEQ ID NO: 16103 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
gaaatcacatccattagata

SEQ ID NO: 16104 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGCTT
gtgctcagctgaaccagagc

SEQ ID NO: 16105 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGCTT
gccagggaattctccaccag

SEQ ID NO: 16106 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
atttaaaactccataatgag

SEQ ID NO: 16107 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
taattatttaaaactccata

SEQ ID NO: 16108 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGCTT
atggtatcaggttgatgatg

SEQ ID NO: 16109 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGTGTTT
aagtactattttaacattgt

SEQ ID NO: 16110 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGCTT
ttctccccattttacgggtt

SEQ ID NO: 16111 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACGGGTTT
tagttttttctccccatttt

SEQ ID NO: 16112 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGTTT
acttaccaatataccaactt

SEQ ID NO: 16113 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
tcagataaatccatgagtag

SEQ ID NO: 16114 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGCTT
gttatttagatcacattgta

SEQ ID NO: 16115 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGTTT
tcaccatcattaatttacca

SEQ ID NO: 16116 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAGGCTT
tactgcagtctgcttttatt

SEQ ID NO: 16117 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
ttagtttcagtcttactgca

SEQ ID NO: 16118 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGTTT
gctaatgccttatttggttt

SEQ ID NO: 16119 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
aggtccttgctaatgcctta

SEQ ID NO: 16120 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGCTT
attgatgttttgtgattgaa

SEQ ID NO: 16121 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGCTT
aatgattgatgttttgtgat

SEQ ID NO: 16122 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
tttaattaatgattgatgtt

SEQ ID NO: 16123 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
gatgtactttaattaatgat

SEQ ID NO: 16124 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
aaagcaagatgtactttaat

SEQ ID NO: 16125 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTTGATT
attccttgtcttacttttca

SEQ ID NO: 16126 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
tggaattccttgtcttactt

SEQ ID NO: 16127 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGATT
gctcatagttctaaaatagg

SEQ ID NO: 16128 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCCGTTT
agcagcacagaaatctggag

SEQ ID NO: 16129 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
ttaaatcttggtttagagaa

SEQ ID NO: 16130 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGTTT
cgatcctggaacttttaaat

SEQ ID NO: 16131 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
cttttttcaaaagaaatttg

SEQ ID NO: 16132 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
cacttcggcctcccaaagtg

SEQ ID NO: 16133 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGGGTTT
tttttgtatttttgaaggga

SEQ ID NO: 16134 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ttgcttggtgttaggcaact

SEQ ID NO: 16135 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGCTT
atattacataatttattcaa

SEQ ID NO: 16136 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGATT
ataatttttttttagtcatg

SEQ ID NO: 16137 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGATT
ttctgtacatagtggggagc

SEQ ID NO: 16138 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
taagacaaatttcctgtcta

SEQ ID NO: 16139 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGCTT
attagatagcgtgcttcttc

SEQ ID NO: 16140 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCGTGCTT
aaaggcaatataattagata

SEQ ID NO: 16141 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tgatagttatggattattgt

SEQ ID NO: 16142 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGATT
gatgtaaaatcaatgatagt

SEQ ID NO: 16143 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGCGTTT
agagtgccataaattaaaga

SEQ ID NO: 16144 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
atggaaattgctttgttttt

SEQ ID NO: 16145 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
ccataaaaggatggaaattg

SEQ ID NO: 16146 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGCTT
agcctccataaaaggatgga

SEQ ID NO: 16147 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
aattaaacctaagcagatag

SEQ ID NO: 16148 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
tctgaccaaacttttaacct

SEQ ID NO: 16149 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
ctgctgtgaacttaaaaact

SEQ ID NO: 16150 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGCTT
ataaaatatctacaatttta

SEQ ID NO: 16151 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
ttggcaatttgtccttaaat

SEQ ID NO: 16152 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGATT
tgatcgctttgttggatgtt

SEQ ID NO: 16153 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATCGCTT
tctaaaacaattaaatactt

SEQ ID NO: 16154 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGTTT
atctaggattgtatctgtgc

SEQ ID NO: 16155 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGATT
agttagggttaatcaaccat

SEQ ID NO: 16156 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGCTT
cttctccctgttatttgcgt

SEQ ID NO: 16157 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGCTT
tggaaatgaaatcttttcag

SEQ ID NO: 16158 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
ctttctgcaaataaatgtgt

SEQ ID NO: 16159 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
atttatttttttctatgctt

SEQ ID NO: 16160 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGCTT
ttaatttcatttattttttt

SEQ ID NO: 16161 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
ggtttggaggttgcagtcag

SEQ ID NO: 16162 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGTTT
gggaagaacacttgagccca

SEQ ID NO: 16163 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
acttaacattgtgggaaaat

SEQ ID NO: 16164 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
acgttttaaatatcaaatta

SEQ ID NO: 16165 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAACGTTT
gaaattcacattttagataa

SEQ ID NO: 16166 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
actgaccaaagaagaactag

SEQ ID NO: 16167 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCAGTTT
atttctattcatttttgaaa

SEQ ID NO: 16168 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
aaaaaatctcatttctaggc

SEQ ID NO: 16169 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
gcagaggctgagcaggatag

SEQ ID NO: 16170 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGTTT
aaaaatgtagagtattaata

SEQ ID NO: 16171 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGTTT
acttgaatgaatgaatgaat

SEQ ID NO: 16172 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGCTT
cttggagttactaactgctc

SEQ ID NO: 16173 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGAGTTT
atttttcgttatacatactt

SEQ ID NO: 16174 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
tgacgaaggaaggtatgaaa

SEQ ID NO: 16175 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGATT
tgatacagaaagatttccaa

SEQ ID NO: 16176 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAAGATT
gctttatacatgctgataca

SEQ ID NO: 16177 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTAGCTT
atgaagctgctataaaaaga

SEQ ID NO: 16178 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTAGCTT
actaatgagaagataattat

SEQ ID NO: 16179 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
gtagaacaaaaccctgtaac

SEQ ID NO: 16180 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGCTT
ggaaaaataactaataagta

SEQ ID NO: 16181 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCTGTTT
ggttacaaatggaacatttt

SEQ ID NO: 16182 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGATT
gggtgtcatttagcatgaaa

SEQ ID NO: 16183 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGATT
gcttcttctggtcattgtca

SEQ ID NO: 16184 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGCTT
cgccttcctttttgtccttt

SEQ ID NO: 16185 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGCTT
gaaagtgagcatcaagcaat

SEQ ID NO: 16186 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGTTT
tttcaaaaggtggcatcttt

SEQ ID NO: 16187 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGTTT
aatataccaataacctcctt

SEQ ID NO: 16188 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGATT
gacacattgtttggggagag

SEQ ID NO: 16189 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGTTT
tgtgcaaacaatccctgaca

SEQ ID NO: 16190 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
aaataaataaataaataaat

SEQ ID NO: 16191 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGCTT
tcaggaggctgaggcaggag

SEQ ID NO: 16192 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
tttcggccgggtgtggtggc

SEQ ID NO: 16193 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
aactaaaatgataagaatta

SEQ ID NO: 16194 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
attcaatttaattaaaatgt

SEQ ID NO: 16195 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
aaacacaggagccactggag

SEQ ID NO: 16196 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGTTT
ataatatatcaatgtcatta

SEQ ID NO: 16197 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tagaagaaaacatgtgaagg

SEQ ID NO: 16198 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGTTT
actgctagaagaaaacatgt

SEQ ID NO: 16199 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGCTT
ggataaaaataaattcagat

SEQ ID NO: 16200 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
gtcatgtggataaaaataaa

SEQ ID NO: 16201 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGCTT
aggtattaaaaaaagagtca

SEQ ID NO: 16202 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGTTT
gtgatattatacttggcata

SEQ ID NO: 16203 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCTGTTT
ctaaaatgagtagccagcct

SEQ ID NO: 16204 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
tttggtttcatatatattgt

SEQ ID NO: 16205 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
caagtatttaatgaaaagta

SEQ ID NO: 16206 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAAGATT
tacttatgaaggatgcaatg

SEQ ID NO: 16207 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGATT
attattttaagaatttattt

SEQ ID NO: 16208 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGATT
tactcttgttgaagttatta

SEQ ID NO: 16209 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAATGATT
ctataaaatgccataaaatt

SEQ ID NO: 16210 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
attatcgcatatacagctta

SEQ ID NO: 16211 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGCTT
gaatataaaattatcgcata

SEQ ID NO: 16212 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
taaaataataaatataatat

SEQ ID NO: 16213 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctcggcttcccaaagtg

SEQ ID NO: 16214 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCGGCTT
acctcaggtgatccgcctgc

SEQ ID NO: 16215 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGGGTTT
ttttgtatttttagtagaga

SEQ ID NO: 16216 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctcagcctcctgagtag

SEQ ID NO: 16217 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGAGTTT
ttttttttttttttttgaga

SEQ ID NO: 16218 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
ttcccagggtaatacacttc

SEQ ID NO: 16219 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
agcaaatgttgacactaatc

SEQ ID NO: 16220 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGGGATT
aagtcttaactaacagagag

SEQ ID NO: 16221 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
cactttctcctaaatcatgt

SEQ ID NO: 16222 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATGGCTT
tttgtgtttattggccaact

SEQ ID NO: 16223 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGTTT
cataagattttcgtaaggtt

SEQ ID NO: 16224 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGTTT
tactccacataagattttcg

SEQ ID NO: 16225 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
aggtaacaaatatactccac

SEQ ID NO: 16226 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACATGTTT
attttaaattaaagccataa

SEQ ID NO: 16227 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGCTT
tccggtttgctatataagaa

SEQ ID NO: 16228 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCGGTTT
aaaggattatcattttcagc

SEQ ID NO: 16229 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGATT
ttttccactaaaataacctt

SEQ ID NO: 16230 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGCTT
atattctcgttcctaagaac

SEQ ID NO: 16231 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGCTT
aggttttgtatatgcaatac

SEQ ID NO: 16232 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
ttgaaagctccctaagaaga

SEQ ID NO: 16233 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGTTT
ttggtagaaggcaatgtagt

SEQ ID NO: 16234 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATGGATT
tatccacatttatcaaacct

SEQ ID NO: 16235 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
ctttggttcccatgatattc

SEQ ID NO: 16236 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
tagagggtcatcattactgt

SEQ ID NO: 16237 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
catcagcagctgttactgtg

SEQ ID NO: 16238 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGCTT
tatttcatcagcagctgtta

SEQ ID NO: 16239 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGCTT
cttattttgatattgaatta

SEQ ID NO: 16240 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCATGCTT
tccaaagaatactttggcat

SEQ ID NO: 16241 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGTTT
aaatcttatgagtagatgtc

SEQ ID NO: 16242 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATAGATT
ttacccccttcctttgctaa

SEQ ID NO: 16243 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCAGATT
tgttcctttagactcctcaa

SEQ ID NO: 16244 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAGGTTT
tatgaacatgttagtttgca

SEQ ID NO: 16245 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTAGTTT
gaagtcatatctatgaacat

SEQ ID NO: 16246 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGATT
cacatgagtttcatcatatt

SEQ ID NO: 16247 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGAGTTT
tgcattttaaacaatatcac

SEQ ID NO: 16248 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
cttcctattcatttgtgatc

SEQ ID NO: 16249 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
cttggattctgagataaagc

SEQ ID NO: 16250 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
atataaatttgatcaggagt

SEQ ID NO: 16251 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTTGCTT
tgaaccgtttttgcctatgc

SEQ ID NO: 16252 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACCGTTT
tttgtcattgaattgttgtg

SEQ ID NO: 16253 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
gtgtttataccacagatatt

SEQ ID NO: 16254 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
gaaaactgaagttttaaggt

SEQ ID NO: 16255 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
aagagtttgttaccgaaaac

SEQ ID NO: 16256 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGTTT
ttttgttaaagtgttttcag

SEQ ID NO: 16257 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
tttttcactcagttttgtta

SEQ ID NO: 16258 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGTTT
gtaaagtcacttatttttca

SEQ ID NO: 16259 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGATT
tgatttctactatttagaat

SEQ ID NO: 16260 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGATT
ttctcaacggtcaagtagat

SEQ ID NO: 16261 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGTTT
tgagtaagaaagaaaagcta

SEQ ID NO: 16262 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGTGCTT
tacaaggctttgcacagaga

SEQ ID NO: 16263 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGCTT
aatccacacagaccatttta

SEQ ID NO: 16264 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAGGATT
ctagatatgattaaatcaaa

SEQ ID NO: 16265 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
ccttcattttctaatcctag

SEQ ID NO: 16266 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
tcccatttcattttgttttg

SEQ ID NO: 16267 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
tttcaagaactcccatttca

SEQ ID NO: 16268 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGTTT
atacccattgtccccagaga

SEQ ID NO: 16269 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCAGCTT
tcgtagactctaagagagtt

SEQ ID NO: 16270 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGAGTTT
atataattcgtagactctaa

SEQ ID NO: 16271 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGATT
cgtttaggtctgtgattcat

SEQ ID NO: 16272 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
tctaactctgacgtttaggt

SEQ ID NO: 16273 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGACGTTT
gaaatttacagttctaactc

SEQ ID NO: 16274 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGAAGATT
atgtgccaaatctaatgtct

SEQ ID NO: 16275 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCGTGCTT
ctctttttttcttttgttga

SEQ ID NO: 16276 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
agtagtgttctttgatgcac

SEQ ID NO: 16277 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGATT
gcaattattttctcccatca

SEQ ID NO: 16278 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
atgttaatcccttatcagat

SEQ ID NO: 16279 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCTTGTTT
cctttgttcatttttaatct

SEQ ID NO: 16280 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGCTT
aaatcctttgttcattttta

SEQ ID NO: 16281 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGATT
atgttgagcatcttcccatg

SEQ ID NO: 16282 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGATT
gaagtgatattttattgtgg

SEQ ID NO: 16283 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
agtgtgaagtgatattttat

SEQ ID NO: 16284 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAATGTTT
caatttctccacacccttgt

SEQ ID NO: 16285 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGTGTTT
aattttttgaggaaccacca

SEQ ID NO: 16286 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
attgctggatcatgtgatat

SEQ ID NO: 16287 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
ctacatgcgtcccttctatt

SEQ ID NO: 16288 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
ttgttttcactttttggcta

SEQ ID NO: 16289 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTTGTTT
catctgttgatagacatttg

SEQ ID NO: 16290 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ttattgtgcatttatacaca

SEQ ID NO: 16291 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ctggcttatttcacttagca

SEQ ID NO: 16292 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGCTT
atagcatttgtcttttcatg

SEQ ID NO: 16293 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGTTT
cattttaaccatttcaaatg

SEQ ID NO: 16294 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGATT
ggttgaccggttgctaactg

SEQ ID NO: 16295 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
gatcaattttgatgtttatt

SEQ ID NO: 16296 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
ttgtatatttcgatcaattt

SEQ ID NO: 16297 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ttacaattgagagtaacttt

SEQ ID NO: 16298 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGATT
agggggcagggctaataaga

SEQ ID NO: 16299 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGATT
tctcttcctgtctgtaatgg

SEQ ID NO: 16300 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGATT
tatattctcttcctgtctgt

SEQ ID NO: 16301 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGATT
tgcatgtatatgtatttatg

SEQ ID NO: 16302 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
aataatgtttttgtcttttt

SEQ ID NO: 16303 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
ttctaatttctatacaaaaa

SEQ ID NO: 16304 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGTTT
aaaccagaaaaaaatgtttg

SEQ ID NO: 16305 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
ggtaacataaaaccagaaaa

SEQ ID NO: 16306 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGATT
gagggtttttcttgattttg

SEQ ID NO: 16307 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTTGATT
aagcagaagatgagggtttt

SEQ ID NO: 16308 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGGGTTT
caagattgaaagcagaagat

SEQ ID NO: 16309 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAAGATT
gcatggttgaaatacagaca

SEQ ID NO: 16310 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGCCGATT
aacaacacatggagatgtga

SEQ ID NO: 16311 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
ttccctctcttccttcttca

SEQ ID NO: 16312 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGTTT
caagttggtattggtgccat

SEQ ID NO: 16313 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGGGATT
ccaactgatttatcttagcc

SEQ ID NO: 16314 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGATT
aagttaaagctgaaatttcc

SEQ ID NO: 16315 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGCTT
aaaacttttgacagtgacag

SEQ ID NO: 16316 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
tcaaagagatatatgcactt

SEQ ID NO: 16317 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAGGTTT
tatcctctagactaagtggt

SEQ ID NO: 16318 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTAGCTT
attttagtgatttgtggatt

SEQ ID NO: 16319 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGATT
ctcaatctattttagtgatt

SEQ ID NO: 16320 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGATT
tgatacgtctcaatctattt

SEQ ID NO: 16321 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
gaaaactaatttattttaca

SEQ ID NO: 16322 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACAGTTT
ttgacttttaagggttttaa

SEQ ID NO: 16323 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGTTT
aatgcaagaagttgactttt

SEQ ID NO: 16324 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
aattaaaaaaatgtctagga

SEQ ID NO: 16325 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGCTT
tggtggccagcacctgtagt

SEQ ID NO: 16326 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGCTT
gtctagggtgggccaggcgc

SEQ ID NO: 16327 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGATT
aaaggccttccccaaggtag

SEQ ID NO: 16328 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
actttgctatgattcgcata

SEQ ID NO: 16329 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGATT
actactgtgacttgactttg

SEQ ID NO: 16330 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
tgcatttaaagtgtttttga

SEQ ID NO: 16331 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGTTT
aaagagtacctatgcattta

SEQ ID NO: 16332 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGTTT
gtcaaaatagagattttggt

SEQ ID NO: 16333 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGAGATT
tatattgtgttaagtcaaaa

SEQ ID NO: 16334 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GACTGTTT
acaaaaaaagaaagatggat

SEQ ID NO: 16335 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
gctaccaagcattctatcaa

SEQ ID NO: 16336 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATACGTTT
aaatcttatatattccaaga

SEQ ID NO: 16337 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCCGTTT
tgttaagggattttcatatg

SEQ ID NO: 16338 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGGGATT
tgctaactgagcagtttgtt

SEQ ID NO: 16339 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGTTT
cgtctccttaatgctaactg

SEQ ID NO: 16340 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
acaaggaaaaatacatacgg

SEQ ID NO: 16341 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGGGATT
cacctcggccttctaaagtg

SEQ ID NO: 16342 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGGGTTT
ttttgcagttttagtagaga

SEQ ID NO: 16343 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCAGTTT
ccaccatgcccggctaattt

SEQ ID NO: 16344 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
tgcctcagcctcccaagtag

SEQ ID NO: 16345 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGTGATT
aacctctgcctcccagattc

SEQ ID NO: 16346 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCAGATT
gctcgctgcaacctctgcct

SEQ ID NO: 16347 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCGGTTT
ttttacataggtaaaggtgt

SEQ ID NO: 16348 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCAGGTTT
aaggtacatttgcaggatgt

SEQ ID NO: 16349 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGTTT
ctttttttttttttttttaa

SEQ ID NO: 16350 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
cgcctaggccccccaaagtg

SEQ ID NO: 16351 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAGGATT
attttgtatttttagtagag

SEQ ID NO: 16352 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCGGGATT
tgcctcagcctcccgagtag

SEQ ID NO: 16353 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCGAGTTT
tcttttttttttttttgaga

SEQ ID NO: 16354 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
atatatgtatatacatcgta

SEQ ID NO: 16355 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGCTT
tcaaatattaatttcttaaa

SEQ ID NO: 16356 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAAGTTT
ttcaaattagtatagtgaaa

SEQ ID NO: 16357 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGTTT
ttataaagttgaagtgatga

SEQ ID NO: 16358 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAGTGATT
ggtaagtgatgcctttatct

SEQ ID NO: 16359 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGCTT
cattttgaataggatgaatt

SEQ ID NO: 16360 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
attaaaatttatatttcata

SEQ ID NO: 16361 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGTTT
gcctgggcaataaaaggaaa

SEQ ID NO: 16362 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATTGCTT
ttgggaggccgaggctggag

SEQ ID NO: 16363 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGATT
cactttgggaggccgaggct

SEQ ID NO: 16364 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
aaaacagggaaaaatgagaa

SEQ ID NO: 16365 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGTTT
ttactagttgctcctacact

SEQ ID NO: 16366 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGATT
ccattatctaatgatgatga

SEQ ID NO: 16367 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
cgcctcgacctcccaaagtg

SEQ ID NO: 16368 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGAGTTT
ttttgtatttttagtagaga

SEQ ID NO: 16369 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGTTT
cgcctaccaccgtgcccggc

SEQ ID NO: 16370 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
tccctgtattatctgatttt

SEQ ID NO: 16371 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCTGATT
acacctagactccctgtatt

SEQ ID NO: 16372 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
taagtattaaaaacattccc

SEQ ID NO: 16373 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATAAGATT
gagcctctaaagaaagataa

SEQ ID NO: 16374 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
tctcctacatctcatcttcc

SEQ ID NO: 16375 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGATT
caataaagctctaattgcac

SEQ ID NO: 16376 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAAAGCTT
atgtctccttggatttttta

SEQ ID NO: 16377 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTGGATT
aaatttctttaaaatgtctc

SEQ ID NO: 16378 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGATT
taatttccttgctattcatt

SEQ ID NO: 16379 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGATT
aacacaggagatgaactatc

SEQ ID NO: 16380 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTTGTTT
gtaagcaaaaaatatgttgt

SEQ ID NO: 16381 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
gtaagcataatctgccacag

SEQ ID NO: 16382 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
cttggcagctaaaggtggaa

SEQ ID NO: 16383 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATGGCTT
cctctgccttgctggaagga

SEQ ID NO: 16384 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAGGATT
ttgtataaaaatattttata

SEQ ID NO: 16385 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTTAGATT
ttcctttagaactgtgtaga

SEQ ID NO: 16386 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGATT
attatttcactaattgtgag

SEQ ID NO: 16387 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
ttatgtagcaaatggccagc

SEQ ID NO: 16388 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGATT
caattaggtgacaaactgat

SEQ ID NO: 16389 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AACTGATT
tagctttcaattaggtgaca

SEQ ID NO: 16390 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGCTT
tattaacatttggttgaaaa

SEQ ID NO: 16391 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGTTT
ttaaagatattaaacaaaca

SEQ ID NO: 16392 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGCTT
cccccctttatttttgcaga

SEQ ID NO: 16393 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGGTGATT
acacacacacacactttgta

SEQ ID NO: 16394 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGATT
actgcaaacttcatgctcat

SEQ ID NO: 16395 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGCTT
ggaaggttcagagaggcaat

SEQ ID NO: 16396 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGTTT
ggtttccacacggtctaaat

SEQ ID NO: 16397 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGTTT
gatgaggcggaggccataag

SEQ ID NO: 16398 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGCTT
tattcttttaaaataaacat

SEQ ID NO: 16399 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAGGTTT
aatctaaaatgataaccttg

SEQ ID NO: 16400 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGATT
aaaatatattttaagaaaaa

SEQ ID NO: 16401 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
taaccctggaaacatgaatt

SEQ ID NO: 16402 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGATT
taaataataaaatacaaaaa

SEQ ID NO: 16403 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTAGCTT
gactatgtcttcattgttga

SEQ ID NO: 16404 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACTGCTT
ttggaaccttgtttctttca

SEQ ID NO: 16405 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGTTT
tgttggtcttgatgttggaa

SEQ ID NO: 16406 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
taaatctcaactcgaggttt

SEQ ID NO: 16407 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGAGGTTT
ttaaactttaaatctcaact

SEQ ID NO: 16408 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCGTGCTT
tcccaatgcctgaactctat

SEQ ID NO: 16409 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGTTT
gtaaatgcctttcctcagca

SEQ ID NO: 16410 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
catccaagtattgaaatcac

SEQ ID NO: 16411 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCAGATT
gactttccctaaaactctgt

SEQ ID NO: 16412 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGTTT
catgatcttgtaaaagagct

SEQ ID NO: 16413 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAGAGCTT
gacaagtcatgatcttgtaa

SEQ ID NO: 16414 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GAAGGATT
caaaagagtgtgaagtgcta

SEQ ID NO: 16415 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGAGTTT
ttttactacctgttgctgtg

SEQ ID NO: 16416 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
gcccttctgtggtaatgctt

SEQ ID NO: 16417 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGCTT
tcatgggagcccttctgtgg

SEQ ID NO: 16418 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGATGCTT
ggctaggctcacagagtacc

SEQ ID NO: 16419 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCTTGATT
gtgactggatatatgatatg

SEQ ID NO: 16420 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATGTGTTT
tgcagttgtgggactcagtg

SEQ ID NO: 16421 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGAGGTTT
aattttgtagaggtttaaaa

SEQ ID NO: 16422 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGTTT
caagttttttaaaattttgt

SEQ ID NO: 16423 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAAGTTT
aactgatagtttggcttaag

SEQ ID NO: 16424 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGCTT
tctatttaggcaactgatag

SEQ ID NO: 16425 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGTTT
tgccctctatttaggcaact

SEQ ID NO: 16426 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACTAGCTT
caaattttcatgattgttag

SEQ ID NO: 16427 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGATT
gatccctgtgtcgcaaattt

SEQ ID NO: 16428 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTAGTTT
agattttttaaaaattattg

SEQ ID NO: 16429 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATTGATT
tggtgagattttttaaaaat

SEQ ID NO: 16430 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGAGATT
aattttttcttataattatg

SEQ ID NO: 16431 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAAAGTTT
agattttttccactatttaa

SEQ ID NO: 16432 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGATT
gttcattttattgcaaattc

SEQ ID NO: 16433 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGCTT
atttaaatatattttataat

SEQ ID NO: 16434 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGATT
cttcttccctgtagacaaga

SEQ ID NO: 16435 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GATAGCTT
aagtaagctttcaaggaagt

SEQ ID NO: 16436 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTAAGCTT
aagataaaagccaaatcaaa

SEQ ID NO: 16437 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGGGGTTT
aatttacatgagaaacttag

SEQ ID NO: 16438 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATAGATT
tttttttaagttggagcgtt

SEQ ID NO: 16439 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTAGTTT
gtaaacatttcactcattat

SEQ ID NO: 16440 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTGTGATT
agaaacattaatgccagttt

SEQ ID NO: 16441 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGTTT
aagaaactagaaacattaat

SEQ ID NO: 16442 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGCAGATT
gctctgcccctatttctcag

SEQ ID NO: 16443 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACCAGCTT
tgcaaagctgagcgtgcaga

SEQ ID NO: 16444 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCTGTTT
ggtggtttactgtcttttat

SEQ ID NO: 16445 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGTGGTTT
aaggaagggtagcaatgcct

SEQ ID NO: 16446 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTGGGTTT
tcctgtgcggttttgactct

SEQ ID NO: 16447 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCGGTTT
cgatagctgggcagctcctg

SEQ ID NO: 16448 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAAGCTT
acctggaaagaagagagggg

SEQ ID NO: 16449 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGCTGCTT
caagtaagtgccttttcttt

SEQ ID NO: 16450 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GCCAGATT
ggcccgcgccctctcctgga

SEQ ID NO: 16451 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCGGCTT
ccagcgctccagcggcggct

SEQ ID NO: 16452 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTCTGCTT
gccctggcaggaggggcgca

SEQ ID NO: 16453 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCCGATT
agtgacttctcggaaacatt

SEQ ID NO: 16454 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CGGAGTTT
ggtccccacctcctctgctc

SEQ ID NO: 16455 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CAGGGCTT
cccagccactgccccagact

SEQ ID NO: 16456 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGATT
cctggaagacgctgcaattc

SEQ ID NO: 16457 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGCTT
tcttcgaaagaaaatgtatt

SEQ ID NO: 16458 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTCTGATT
ctttccccacctaggacctc

SEQ ID NO: 16459 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCACGTTT
ctggaaaagcagccttttcc

SEQ ID NO: 16460 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCCTGTTT
ctttgagaaagataattcaa

SEQ ID NO: 16461 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCCTGTTT
ttcttcccttggtggaaatt

SEQ ID NO: 16462 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTTTGATT
caccctgccctatggccatc

SEQ ID NO: 16463 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
ataataaaagtgcccgtcac

SEQ ID NO: 16464 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTTGATT
agggaaaagtagaccctggg

SEQ ID NO: 16465 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGATT
gcagcagggaaaagtagacc

SEQ ID NO: 16466 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGAAGTTT
cattgcacagtctcagtcac

SEQ ID NO: 16467 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGGCGATT
accaccaatcagggaagaga

SEQ ID NO: 16468 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CATTGCTT
ttaaaaataaaagaatgtgg

SEQ ID NO: 16469 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTCAGTTT
ggaaatctctgtaccctccc

SEQ ID NO: 16470 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AAATGTTT
gtaagttcattaattttaac

SEQ ID NO: 16471 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGCTT
accttcacaaagatgtttat

SEQ ID NO: 16472 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGATGTTT
ccacacagtaaccttcacaa

SEQ ID NO: 16473 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGCAGTTT
agccactttgaggacagtgt

SEQ ID NO: 16474 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAAAGCTT
tgttaaccaaaatatacaaa

SEQ ID NO: 16475 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GGATGCTT
aatagtaagttcttgttaat

SEQ ID NO: 16476 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTATGTTT
ttttatcattttccaggatt

SEQ ID NO: 16477 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CCAGGATT
atttttggttttatcatttt

SEQ ID NO: 16478 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTGGTTT
cagaccaagaggattttatt

SEQ ID NO: 16479 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGAGGATT
gggatccctcagtcagacca

SEQ ID NO: 16480 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAATGCTT
aaaataatgaataatatacc

SEQ ID NO: 16481 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGGGTTT
aatttggaaagatacttttt

SEQ ID NO: 16482 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
ctacatctgacgctgtcatt

SEQ ID NO: 16483 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGCTT
ttattggctttttcaaccag

SEQ ID NO: 16484 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATTGGCTT
tgattaggaacttattggtt

SEQ ID NO: 16485 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATATGATT
ttacggaaggtcagttgtaa

SEQ ID NO: 16486 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TATGGATT
aattcttattcctattctgg

SEQ ID NO: 16487 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TACAGTTT
tttgttcttccagaaacttc

SEQ ID NO: 16488 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATTGTTT
ttctattttcacaacagaat

SEQ ID NO: 16489 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AGTTGTTT
ttaggaaacctcttttcttc

SEQ ID NO: 16490 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ATCAGTTT
aaacatttatttttcttcac

SEQ ID NO: 16491 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: AATAGTTT
tacaagggaatgtcgataac

SEQ ID NO: 16492 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TAGTGTTT
gttgcccaatgactgaaaac

SEQ ID NO: 16493 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TGTGGTTT
atgtttccatcttcctgagc

SEQ ID NO: 16494 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCATGTTT
aactcttattttctggctct

SEQ ID NO: 16495 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTTTGTTT
ctttctctggcttagggtat

SEQ ID NO: 16496 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TCTGGCTT
tgcatgactgtagttctttc

SEQ ID NO: 16497 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTAGGTTT
tatgtagtagactataccat

SEQ ID NO: 16498 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: ACAGGTTT
tcagtacagtaacatgttgt

SEQ ID NO: 16499 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: GTATGATT
tgtaacttttctatgtttag

SEQ ID NO: 16500 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTATGTTT
gtatttttactgtaactttt

SEQ ID NO: 16501 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CACAGATT
tgcatatatgatggtggtcc

SEQ ID NO: 16502 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: TTAAGATT
aagaatttttaacctgctac

SEQ ID NO: 16503 - DNA, 20 bp, synthetic construct
  source 1..20: mol_type = other DNA; note = Description of Artificial Sequence: Synthetic oligonucleotide; note = Target: SCN9A; (-) strand; PAM type: NNNNGHTT; PAM sequence: CTGTGTTT
cagagtctacccaatatctc

SEQ ID NO: 16504 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGATT
gctaaggtaatgtcggttat

SEQ ID NO: 16505 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGATT
gatcagtcgttgtcaactgg

SEQ ID NO: 16506 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
tgtcataactgtggaattag

SEQ ID NO: 16507 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGATT
agaattatccagctcaaata

SEQ ID NO: 16508 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGATT
caggccttagagaaataaat

SEQ ID NO: 16509 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
ttttaatgtagaatgtatat

SEQ ID NO: 16510 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGTTT
tatttcctacttgacattat

SEQ ID NO: 16511 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCAGTTT
taacttagtccttcaaaaat

SEQ ID NO: 16512 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGTTT
ttttattttgtgagcagtgg

SEQ ID NO: 16513 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGATT
aaactattgaggctgaagca

SEQ ID NO: 16514 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGCTT
gctgacatggtgtagggctg

SEQ ID NO: 16515 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGTTT
acttgtagacagtaatagta

SEQ ID NO: 16516 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGATT
agagtttgtaaaatctttgc

SEQ ID NO: 16517 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
actctggctactgtactgag

SEQ ID NO: 16518 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGATT
agatttggaagtgaggcaag

SEQ ID NO: 16519 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGATT
ataaagaggttaaaggtggt

SEQ ID NO: 16520 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGATT
gaggttaaaggtggtaatgg

SEQ ID NO: 16521 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGATT
taaatgcggagggttaatga

SEQ ID NO: 16522 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
gcggagggttaatgaagagg

SEQ ID NO: 16523 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGATT
agttgtcccttagtatctgc

SEQ ID NO: 16524 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGCTT
tcccttagtatctgctgggg

SEQ ID NO: 16525 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGTTT
aatctcttatacaaatggca

SEQ ID NO: 16526 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGCTT
tcttatacaaatggcatagt

SEQ ID NO: 16527 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
aacctacacacatcctccta

SEQ ID NO: 16528 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGATT
cctacacatcacttcatttg

SEQ ID NO: 16529 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGTTT
gtactcagcatatggaaaat

SEQ ID NO: 16530 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGCTT
aaaattcaagttttgccttt

SEQ ID NO: 16531 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGATT
agttttgccttttggggctt

SEQ ID NO: 16532 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGATT
atatatatatatcttccacc

SEQ ID NO: 16533 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCAGCTT
tggtatattattatgacagc

SEQ ID NO: 16534 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGCTT
gataatactctggctcctgc

SEQ ID NO: 16535 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAACGTTT
aactttttatgttccaaatg

SEQ ID NO: 16536 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
acgttttagaagacatttgc

SEQ ID NO: 16537 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGATT
catgagtgggacaagtatac

SEQ ID NO: 16538 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
tttgactttgagaaaattac

SEQ ID NO: 16539 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
acttaagattgcccattttc

SEQ ID NO: 16540 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGCTT
cttctgggtaaaaatttgta

SEQ ID NO: 16541 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACACGATT
taaggtgcactgaatggtaa

SEQ ID NO: 16542 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
ttgataagataacaattaac

SEQ ID NO: 16543 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
ccacagtctgtatgagccat

SEQ ID NO: 16544 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
tggaaaacaggagcatgcat

SEQ ID NO: 16545 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGCTT
taacaaatgatcacaaattt

SEQ ID NO: 16546 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
aggagcctgggtatagttat

SEQ ID NO: 16547 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGTTT
gaaggaattagtgtatcaca

SEQ ID NO: 16548 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
agccataagtaaaagaatgt

SEQ ID NO: 16549 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGATT
tttaaagcagcacatgcaaa

SEQ ID NO: 16550 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
actgaactaacttgaagaca

SEQ ID NO: 16551 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
aataacttttgctcagttct

SEQ ID NO: 16552 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGCTT
ttttctgtatacttattgtg

SEQ ID NO: 16553 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
tattgtgcattgcttttatc

SEQ ID NO: 16554 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
tgtttctaaagatatattta

SEQ ID NO: 16555 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGCTT
taagtgtagcatgtgagctc

SEQ ID NO: 16556 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTTGTTT
tgtagcatgtgagctctatt

SEQ ID NO: 16557 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
tgtttataactatcaattat

SEQ ID NO: 16558 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGATT
gtaatttctccctcccttga

SEQ ID NO: 16559 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
accatgtatcctgcagctca

SEQ ID NO: 16560 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGCTT
ttatctacaatgtgaaagaa

SEQ ID NO: 16561 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGATT
atcacaatcacttatgttga

SEQ ID NO: 16562 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGATT
aaatggattacagtattatt

SEQ ID NO: 16563 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGCTT
taatgaccatcaacaggact

SEQ ID NO: 16564 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGATT
cctttataaatgtgcatatt

SEQ ID NO: 16565 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
catatttcctgattttaata

SEQ ID NO: 16566 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
actactaatataaattttca

SEQ ID NO: 16567 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
attttcaatgtgttttcagt

SEQ ID NO: 16568 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
tcattgttttaatttcttca

SEQ ID NO: 16569 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGCTT
attcagcaaactcatagggt

SEQ ID NO: 16570 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGCTT
tatcacctcttaagagctgg

SEQ ID NO: 16571 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGTTT
gtagacatcgctgtgtggct

SEQ ID NO: 16572 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
gtggctagatgtttgcatat

SEQ ID NO: 16573 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGATT
tccctttgcacaaaccttga

SEQ ID NO: 16574 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGATT
tcaagaaattactttggaac

SEQ ID NO: 16575 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
tctagattctttgtccttgt

SEQ ID NO: 16576 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGATT
tattttgtataacttttatt

SEQ ID NO: 16577 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGCTT
tttgtaaagaatcctatgta

SEQ ID NO: 16578 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
atttattttcatgaagcaat

SEQ ID NO: 16579 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGTTT
attttcatgaagcaattctt

SEQ ID NO: 16580 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGCTT
tctctgaaatagctatttag

SEQ ID NO: 16581 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGATT
aggttctctaattttcatcc

SEQ ID NO: 16582 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGTTT
tccgaaagatttgtgttcaa

SEQ ID NO: 16583 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGTTT
cagtaggaacacttgaagcc

SEQ ID NO: 16584 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGCTT
ttgggaggctgaggcaggag

SEQ ID NO: 16585 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
agcgagacctggtcacttaa

SEQ ID NO: 16586 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGTTT
cttaaaaaagtttttagaaa

SEQ ID NO: 16587 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGCTT
aaaaagtttttagaaaacct

SEQ ID NO: 16588 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGCGATT
attgttgggtgtaataagtt

SEQ ID NO: 16589 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGCTT
aagagaggtctaattttact

SEQ ID NO: 16590 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGAGTTT
ttcataatgcagttatattt

SEQ ID NO: 16591 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTAGATT
atttgtgagtttgaaataac

SEQ ID NO: 16592 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAGGCTT
attatcaaaacctatttcca

SEQ ID NO: 16593 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTAGATT
tggtataaagaatctttagc

SEQ ID NO: 16594 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
aaagaatctttagccctaga

SEQ ID NO: 16595 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGTAGATT
gccctagattgagttttata

SEQ ID NO: 16596 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
ctcattctttaaccataaat

SEQ ID NO: 16597 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTACGTTT
ataaatctttgtttctatag

SEQ ID NO: 16598 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGCTT
ttgccagaacaacaaaaaat

SEQ ID NO: 16599 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
atggaaagcaaattagtgaa

SEQ ID NO: 16600 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
tagtgaaagttgttttatat

SEQ ID NO: 16601 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGTTT
cttttcaaattactattaat

SEQ ID NO: 16602 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGCTT
acagctaatgcaaaatgaat

SEQ ID NO: 16603 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGATT
attagaagcccatggtactg

SEQ ID NO: 16604 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
atacattgaagtatatccaa

SEQ ID NO: 16605 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGCTT
gttggcaagaatccctattt

SEQ ID NO: 16606 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
tgtgtaaagtctgtcatatt

SEQ ID NO: 16607 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGCTT
tctgtcatattacatgattt

SEQ ID NO: 16608 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACGGGATT
gatttgaaagcttgccaaac

SEQ ID NO: 16609 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGATT
aacaactaactgcatatcag

SEQ ID NO: 16610 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
atcaggaaggatttcatcaa

SEQ ID NO: 16611 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
aaagcaggaaaatttgacaa

SEQ ID NO: 16612 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
ataacttttttctcagttat

SEQ ID NO: 16613 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGATT
aaagccaaggcaaatacttt

SEQ ID NO: 16614 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
tttccaaataatagataaat

SEQ ID NO: 16615 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
tagatttttctgtatgcgtg

SEQ ID NO: 16616 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aaagatgacaaggcagatgt

SEQ ID NO: 16617 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGATT
taaaagttttctacatggtc

SEQ ID NO: 16618 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTACGATT
ataattcctacagagttctc

SEQ ID NO: 16619 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
cttcgagaatattttgataa

SEQ ID NO: 16620 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
tttggcatagacttcctcaa

SEQ ID NO: 16621 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
atcaaaaatgaagctctatt

SEQ ID NO: 16622 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTGGCTT
cttgttcatatttctctttg

SEQ ID NO: 16623 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGTTT
gaggtggtggatgaagtggc

SEQ ID NO: 16624 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGTTT
tgacagtagcagacacatcc

SEQ ID NO: 16625 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCCGTTT
tagcagacacatcctcttgt

SEQ ID NO: 16626 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGATT
tgggttcataggacactttg

SEQ ID NO: 16627 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACACGCTT
tctccccactctcacccaaa

SEQ ID NO: 16628 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGTTT
tggcaatgagctggactttg

SEQ ID NO: 16629 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGTTT
ccagggcagctgcaaaatca

SEQ ID NO: 16630 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGCTT
ctttttttgggtcacagtcg

SEQ ID NO: 16631 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAGGATT
ctttgctcctttgactagac

SEQ ID NO: 16632 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATACGTTT
aacagggtaggggacacaaa

SEQ ID NO: 16633 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
tacctgaaatgatgactcta

SEQ ID NO: 16634 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGTTT
ctcatttcttatgaattcaa

SEQ ID NO: 16635 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGGGTTT
ttttgtatttttagtagaga

SEQ ID NO: 16636 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
cgcctcggcctcccaaagtg

SEQ ID NO: 16637 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
actgaatgcaattacttaaa

SEQ ID NO: 16638 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGTTT
gccattttttccctccataa

SEQ ID NO: 16639 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGCTT
aacaaatgtattcatgttat

SEQ ID NO: 16640 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
aatctctgcatcccgggatc

SEQ ID NO: 16641 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
ccaccacacctggttaattt

SEQ ID NO: 16642 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACGGTTT
atttttgtgtttttggtagg

SEQ ID NO: 16643 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
ggtctcaaacttctgacttc

SEQ ID NO: 16644 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
cacctcggcctcccaatgtg

SEQ ID NO: 16645 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGTTT
tttactttatatgtcatgga

SEQ ID NO: 16646 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGTTT
aaattgaagactagcattta

SEQ ID NO: 16647 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
aacttgggtcaacagtatat

SEQ ID NO: 16648 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
tgagtgctaccattcttctt

SEQ ID NO: 16649 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
aaaataatccacaattttcc

SEQ ID NO: 16650 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGTTT
tgttattttgtatccttatt

SEQ ID NO: 16651 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
ccttattggttgtttttaac

SEQ ID NO: 16652 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
ggttgtttttaacttctgtt

SEQ ID NO: 16653 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGTTT
tttttaacttctgtttttgg

SEQ ID NO: 16654 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGATT
ggtatttgcccatgtgtcta

SEQ ID NO: 16655 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGATT
gtctttcaaccttttattta

SEQ ID NO: 16656 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
gattttttccccaaagaata

SEQ ID NO: 16657 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
atttcttcttcatttttttt

SEQ ID NO: 16658 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
ttttttttggctttacaaat

SEQ ID NO: 16659 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
ctagaatctttttttttaac

SEQ ID NO: 16660 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
tctttttttttaactttaga

SEQ ID NO: 16661 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
gtaaattggtaattatacat

SEQ ID NO: 16662 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGCTT
ttggactctcttcaaaccca

SEQ ID NO: 16663 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
ccactgagcttttatatttg

SEQ ID NO: 16664 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
tttagaatcatttagactta

SEQ ID NO: 16665 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGATT
attgatattttccttgaatt

SEQ ID NO: 16666 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGCTT
aaagtcttaattacaatgag

SEQ ID NO: 16667 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGCTT
atgacaatcctttcaattat

SEQ ID NO: 16668 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
tttagctttcttttatatcc

SEQ ID NO: 16669 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGATT
tatttttattgcaattgtga

SEQ ID NO: 16670 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
ctctaattgaatttattttt

SEQ ID NO: 16671 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
atattaaggatcatttactc

SEQ ID NO: 16672 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGTTT
ttgtttttatatatgtacct

SEQ ID NO: 16673 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGCTT
tttttttcctgacttaatag

SEQ ID NO: 16674 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
tggtatgacttctggtgata

SEQ ID NO: 16675 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
ataatatgcttttccaaaat

SEQ ID NO: 16676 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
tttccaaaattattgatttt

SEQ ID NO: 16677 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGATT
ctgttatgtggcactcaatt

SEQ ID NO: 16678 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGATT
gtcatgcaaccttgaacctt

SEQ ID NO: 16679 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGATT
accttttcagattgataacc

SEQ ID NO: 16680 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
ctctataatctctctctctt

SEQ ID NO: 16681 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
gaacaccatggctggttgag

SEQ ID NO: 16682 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGATT
gtgctaaaaccagaagttat

SEQ ID NO: 16683 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
gaagttatttcagattcaac

SEQ ID NO: 16684 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGTTT
agctatatataaacatggta

SEQ ID NO: 16685 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
ccttctaatagatagaaata

SEQ ID NO: 16686 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
ctgtagtatgagagacagat

SEQ ID NO: 16687 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
gtatgagagacagatatttg

SEQ ID NO: 16688 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGATT
acagatatttgttttgcttt

SEQ ID NO: 16689 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
tatacttccttgagcataag

SEQ ID NO: 16690 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGCTT
ttccttgagcataagtgaag

SEQ ID NO: 16691 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGTTT
agtagtagtgtctgagggag

SEQ ID NO: 16692 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
tagcacacattctccagtga

SEQ ID NO: 16693 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGCTT
agaaccatgatactaatatc

SEQ ID NO: 16694 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTTGATT
ccatgatactaatatcaaag

SEQ ID NO: 16695 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGATT
cactaggtcaaatatacatc

SEQ ID NO: 16696 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGCTT
tttttacccctggtcgagga

SEQ ID NO: 16697 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGCTT
ctggtcgaggaattggcttt

SEQ ID NO: 16698 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCAGCTT
gcttttgtggcttcttggac

SEQ ID NO: 16699 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGATT
aatcattgtctacatctttc

SEQ ID NO: 16700 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGATT
aatatttgtattacatataa

SEQ ID NO: 16701 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
tcttttggtgtgctaatcag

SEQ ID NO: 16702 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGATT
aaagtaatgaatatcttctt

SEQ ID NO: 16703 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGCTT
cacaaaaacaagcaacgggg

SEQ ID NO: 16704 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGATT
ttgtacaaaaattaactcaa

SEQ ID NO: 16705 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGCTT
aatgggatctaattaaacta

SEQ ID NO: 16706 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAACGCTT
gagaggatgtggagaaatag

SEQ ID NO: 16707 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGATT
aaccattgtggaagacagtg

SEQ ID NO: 16708 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGATT
tcattactgggtatatactc

SEQ ID NO: 16709 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGAGCTT
ccaggggcagttagggggtt

SEQ ID NO: 16710 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGGGATT
tagggggttgggagctttgg

SEQ ID NO: 16711 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
aatacctaatgtaaatgatg

SEQ ID NO: 16712 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGTTT
tatacctatgtaacaaacct

SEQ ID NO: 16713 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
ctacctttttaattctaaat

SEQ ID NO: 16714 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGATT
tggatgtcaacattatcctt

SEQ ID NO: 16715 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
cccaaactgaaggactttcc

SEQ ID NO: 16716 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGTTT
taaataacataacatctaaa

SEQ ID NO: 16717 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGCTT
aaatcttacaaaggggggct

SEQ ID NO: 16718 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
gctaatttcttaagttagct

SEQ ID NO: 16719 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
cttaagttagctgtaagttt

SEQ ID NO: 16720 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGATT
tataattaagaatttatttt

SEQ ID NO: 16721 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGTTT
ggaattaaagatgacctggt

SEQ ID NO: 16722 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGATT
ttatggtttccctttattct

SEQ ID NO: 16723 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGCTT
ttctcttggatttggtaata

SEQ ID NO: 16724 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
tcttatttacttattttttt

SEQ ID NO: 16725 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGCTT
taattgtttgctattgaatg

SEQ ID NO: 16726 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGTTT
agacttccctttctgcctta

SEQ ID NO: 16727 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
gttgttgttgttgttgttgt

SEQ ID NO: 16728 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
tgtctcagcctcccaagtag

SEQ ID NO: 16729 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGGGTTT
ttttgtatttttagtagaga

SEQ ID NO: 16730 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTGGTTT
ggtttcaccatgttggctgg

SEQ ID NO: 16731 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
agccttggcctcccaaagtg

SEQ ID NO: 16732 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGTTT
caccatatccggccacctta

SEQ ID NO: 16733 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGCTT
gccaccttagagtgttttaa

SEQ ID NO: 16734 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
tttgaagagaaaatcaaagt

SEQ ID NO: 16735 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
gagaaaatcaaagtaataga

SEQ ID NO: 16736 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGATT
aagaatgggataaaactaat

SEQ ID NO: 16737 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGTGTTT
ttcaatagagaaacttgcgt

SEQ ID NO: 16738 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
tagagaaacttgcgtgggtg

SEQ ID NO: 16739 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
gcgtgggtgttttgttttcc

SEQ ID NO: 16740 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTAGTTT
gaaggaattctgtaagtcag

SEQ ID NO: 16741 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
gtcctttcttttgtccttgg

SEQ ID NO: 16742 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
tataagagtagtcactgcat

SEQ ID NO: 16743 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
tgacttttgttctaatagta

SEQ ID NO: 16744 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGATT
tgttctaatagtagtatgtt

SEQ ID NO: 16745 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGCTT
catgggtagttgatagagcc

SEQ ID NO: 16746 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGTTT
cattgcattgtggaaaagat

SEQ ID NO: 16747 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGTTT
actgtgctggtatcctgtta

SEQ ID NO: 16748 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGTTT
ttcagtgtgctgcactaggg

SEQ ID NO: 16749 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
atggagcactgaaagaacca

SEQ ID NO: 16750 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTAGATT
caaacataggaaaaggggac

SEQ ID NO: 16751 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGTTT
ggaaaaggggacggtagatt

SEQ ID NO: 16752 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGTTT
gtcagtccataaatcttggt

SEQ ID NO: 16753 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGATT
agttactgaccctaaagaaa

SEQ ID NO: 16754 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
attcaaaataattatcctaa

SEQ ID NO: 16755 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGATT
attgaactaaaaaactccct

SEQ ID NO: 16756 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGCGATT
aaccactgtggaagtccgtg

SEQ ID NO: 16757 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
ccatgactgggtatataccc

SEQ ID NO: 16758 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
ctataaagacgcatgcacac

SEQ ID NO: 16759 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGATT
caaatgtccaacaatgatag

SEQ ID NO: 16760 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
cgggaggctgaggcagagag

SEQ ID NO: 16761 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGTTT
caaattgccaaaagtgaaag

SEQ ID NO: 16762 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGATT
agagctctcttaagatgaac

SEQ ID NO: 16763 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
tgctgagggagttcatcacc

SEQ ID NO: 16764 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
gaataactaaaattacaaaa

SEQ ID NO: 16765 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGATT
tgtgagggaggtattaaaag

SEQ ID NO: 16766 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGATT
taaaagtgaagatttttgat

SEQ ID NO: 16767 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGCTT
atgattgaagttaagttgtt

SEQ ID NO: 16768 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGATT
agtagactattataagatat

SEQ ID NO: 16769 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGATT
aatagtaagtcattacctac

SEQ ID NO: 16770 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGATT
caatgattatttcaaataca

SEQ ID NO: 16771 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGATT
caaaagacctacaatggctg

SEQ ID NO: 16772 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTCGTTT
gttatatgctgtctccagat

SEQ ID NO: 16773 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGATT
tgctgtctccagatactcgt

SEQ ID NO: 16774 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGTTT
tcgtttcagatttaagaaaa

SEQ ID NO: 16775 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
tccttcagtatctacagggt

SEQ ID NO: 16776 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGCTT
ccaagggataccaaaattga

SEQ ID NO: 16777 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGATT
aaaatttgaccctctgtatc

SEQ ID NO: 16778 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGTTT
gatttcacattccatgaata

SEQ ID NO: 16779 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
cctgtaattatatcagccaa

SEQ ID NO: 16780 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGATT
tatggaatctataaacaaac

SEQ ID NO: 16781 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
atagatcacatatcaggtca

SEQ ID NO: 16782 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
atcacatatcaggtcatgaa

SEQ ID NO: 16783 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGATT
gaaatatctcatataaacaa

SEQ ID NO: 16784 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
aaaagtcaacaaaactaaga

SEQ ID NO: 16785 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGATT
aatgaaagaggagaatttac

SEQ ID NO: 16786 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACGGCTT
aaaagaaatgtacaggacca

SEQ ID NO: 16787 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGCTT
acactgtaagaaaagaaaat

SEQ ID NO: 16788 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAGGTTT
ttcagcaacattgtggaata

SEQ ID NO: 16789 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
gaaatgtatttatttctaga

SEQ ID NO: 16790 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGTTT
aaaatcatcttcataattgc

SEQ ID NO: 16791 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGCTT
aacttttataggccctgaca

SEQ ID NO: 16792 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGCTT
ttataggccctgacacagag

SEQ ID NO: 16793 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGCTT
agagcttggcttttagatca

SEQ ID NO: 16794 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGTTT
gaatggcagagataagccat

SEQ ID NO: 16795 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGGGTTT
ctcaagtacaaaaaacgatg

SEQ ID NO: 16796 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGCTT
tgaactgcctgagcactctc

SEQ ID NO: 16797 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACACGTTT
cccatggaaaccattaggct

SEQ ID NO: 16798 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGCTT
acattccccacgccttcttc

SEQ ID NO: 16799 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGGGTTT
ttttgtatttttagtagaga

SEQ ID NO: 16800 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
cgcctcggcctcccaaagtg

SEQ ID NO: 16801 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGCTT
tctaccaccaagaacaggaa

SEQ ID NO: 16802 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGCTT
aacaggaaggtggcttcttc

SEQ ID NO: 16803 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGTTT
cttgctcctgacataattta

SEQ ID NO: 16804 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGCTT
tatgcagtttcttattagag

SEQ ID NO: 16805 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGTTT
atcacatgttaggccaccaa

SEQ ID NO: 16806 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
aacaagttttaacaaattta

SEQ ID NO: 16807 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
gaagattaaaatcatatcga

SEQ ID NO: 16808 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGATT
aacaacctaatattacatct

SEQ ID NO: 16809 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
aaacaaagcaaatactaaaa

SEQ ID NO: 16810 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGATT
cacatttaaaacatcattca

SEQ ID NO: 16811 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGATT
acatcattcaccatgattac

SEQ ID NO: 16812 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGAGCTT
tatgcaaaaactgaaaagtt

SEQ ID NO: 16813 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGTTT
aaagcaagaaataaaattat

SEQ ID NO: 16814 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGTTT
atacataaattcagtaaagt

SEQ ID NO: 16815 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
tctgtacactgaaaactata

SEQ ID NO: 16816 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
ccatactacccaaaataatc

SEQ ID NO: 16817 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCAGTTT
atccctatcaaaattctaat

SEQ ID NO: 16818 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
aaacccaattatttatagtc

SEQ ID NO: 16819 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
attgggccctttctcatacc

SEQ ID NO: 16820 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGATT
ctgtatgacatttatctggg

SEQ ID NO: 16821 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGATT
caaaagacaataagagacaa

SEQ ID NO: 16822 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGATT
aacagagtggagagagagat

SEQ ID NO: 16823 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGTTT
gtgaaaatgtaaattagtac

SEQ ID NO: 16824 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGTTT
taggttggtgcaaatgtaat

SEQ ID NO: 16825 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGATT
agtagaggaataaatcttaa

SEQ ID NO: 16826 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGATT
attcaggacataggcatggg

SEQ ID NO: 16827 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGCTT
aatgggatctaattaaacta

SEQ ID NO: 16828 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
agaatctataaggaacttaa

SEQ ID NO: 16829 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
ttataaagacacatgcacac

SEQ ID NO: 16830 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
ggaaaaataaccaatgcata

SEQ ID NO: 16831 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGTTT
ctgtacaacaaacccctatg

SEQ ID NO: 16832 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGCTT
tatttcaaaattgctaaaag

SEQ ID NO: 16833 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
agcgtgactgaaaatttcta

SEQ ID NO: 16834 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
aatgtttatgtagatcaaaa

SEQ ID NO: 16835 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
aaaaatcacatgatcatcag

SEQ ID NO: 16836 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGTTT
tatagaagttgctataactt

SEQ ID NO: 16837 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGTTT
tgggaggtgagacctttaag

SEQ ID NO: 16838 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGATT
aatgcattaatgctgttatc

SEQ ID NO: 16839 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGTTT
cctccagtactgtgatccca

SEQ ID NO: 16840 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
catcccaatctgaaagaaaa

SEQ ID NO: 16841 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGCGTTT
aatcaacatacaaaaatcac

SEQ ID NO: 16842 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
aaagaaataaaatacttagg

SEQ ID NO: 16843 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGCTT
ctcactgcagcctcatactc

SEQ ID NO: 16844 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGCTT
aggactataggtgtgtgcca

SEQ ID NO: 16845 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
agccttagcctcccgagttg

SEQ ID NO: 16846 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
atacacaaaaataaactcaa

SEQ ID NO: 16847 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGCTT
tgtagaagaaaacatagcag

SEQ ID NO: 16848 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGATT
cttcatgatactgttcttga

SEQ ID NO: 16849 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGCTT
attgagaccatatcaaacta

SEQ ID NO: 16850 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGAGCTT
aatggcgtgaacccgggagg

SEQ ID NO: 16851 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGATT
catggaaacagagagaagaa

SEQ ID NO: 16852 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
gaattgctattcaatgggaa

SEQ ID NO: 16853 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGTTT
ttaagcaggtagatctcata

SEQ ID NO: 16854 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
aagaaaaggataccactttc

SEQ ID NO: 16855 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
ttaactaattgaagtgttgg

SEQ ID NO: 16856 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGATT
gtcagaaaataaaagctata

SEQ ID NO: 16857 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
ctggaagaatgataggggat

SEQ ID NO: 16858 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGCTT
tgataggggatatgagtttt

SEQ ID NO: 16859 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
tttgatgcttctaaatcagt

SEQ ID NO: 16860 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGATT
aagaataacattaacaagca

SEQ ID NO: 16861 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGTTT
attaaagtcaattggatgtt

SEQ ID NO: 16862 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACACGCTT
gctcatactgctctttctag

SEQ ID NO: 16863 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGTGCTT
aagactgaggaattacttgt

SEQ ID NO: 16864 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGCTT
atattacatgtatgtatata

SEQ ID NO: 16865 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
ttgcaaatcacaagcaatac

SEQ ID NO: 16866 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
actgtagattctaccctcta

SEQ ID NO: 16867 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTAGATT
tagtcattttgtgcatcact

SEQ ID NO: 16868 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
taaatgaggatactatgtct

SEQ ID NO: 16869 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGCTT
agtcttaataaacatcaatc

SEQ ID NO: 16870 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACGGCTT
tgctattaaaaaaggtctaa

SEQ ID NO: 16871 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
caattcatttgctcattcat

SEQ ID NO: 16872 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGCTT
ctgactgtcatgtatatttt

SEQ ID NO: 16873 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
aatttttcttattgtattta

SEQ ID NO: 16874 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGTTT
tttggggatagagcatagta

SEQ ID NO: 16875 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGATT
gagactctgtaataatactt

SEQ ID NO: 16876 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGATT
ttttgtgattgatgttatgg

SEQ ID NO: 16877 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGATT
atggcatgtcactataatgg

SEQ ID NO: 16878 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGCTT
gcaataaaatatattttctt

SEQ ID NO: 16879 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGTTT
agtgtgagagaatatatttc

SEQ ID NO: 16880 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGTTT
atttctcttgttttaagccc

SEQ ID NO: 16881 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGATT
agaaactaatacagttgatg

SEQ ID NO: 16882 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
attaattaattaaaaatttc

SEQ ID NO: 16883 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
aataaataactacttataaa

SEQ ID NO: 16884 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
tgtgttttgaataaatagtg

SEQ ID NO: 16885 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGTTT
tgatatattgctcaaaacct

SEQ ID NO: 16886 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
ccagaacctattatttagaa

SEQ ID NO: 16887 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
tgttttctgtgcaaaaatga

SEQ ID NO: 16888 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGCTT
agaggctatattcatatttg

SEQ ID NO: 16889 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
attcattattttctttttca

SEQ ID NO: 16890 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGATT
cagtgctatcctaggtaaac

SEQ ID NO: 16891 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGTTT
ttaagaagccatagcattgt

SEQ ID NO: 16892 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGCTT
ataatcttcaaataactaca

SEQ ID NO: 16893 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
acattttgccatgtattttc

SEQ ID NO: 16894 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
attacctagggagtaatcat

SEQ ID NO: 16895 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGTTT
atttcacataaactcatcca

SEQ ID NO: 16896 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGCTT
atgccagcctgcactaagtg

SEQ ID NO: 16897 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGATT
aacactatggagtaggcatt

SEQ ID NO: 16898 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGATT
tagacatttattagacaaat

SEQ ID NO: 16899 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGATT
aaatgatagattcattaaat

SEQ ID NO: 16900 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGCTT
aatttgcccgaagtcagttg

SEQ ID NO: 16901 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGCTT
tcattgtctatgtgagtccc

SEQ ID NO: 16902 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
tcccaagggcttcatgaagt

SEQ ID NO: 16903 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGCTT
gaaatcactgaaataaacta

SEQ ID NO: 16904 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
aactaagaagcttttaaaaa

SEQ ID NO: 16905 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
tattctaaaatagccataaa

SEQ ID NO: 16906 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGTTT
atagccataaacagagtttt

SEQ ID NO: 16907 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
acaattattaagtaatacta

SEQ ID NO: 16908 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
ttcaacatgtccatttaatg

SEQ ID NO: 16909 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGCTT
taactcaaatgcaacagaac

SEQ ID NO: 16910 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACGTGATT
aacctccgcctcccaggttc

SEQ ID NO: 16911 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGATT
tgcctcagcctcccaagcag

SEQ ID NO: 16912 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGTTT
ttttgtatttttagtagaga

SEQ ID NO: 16913 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGTTT
ctgcgcccggccaagactgg

SEQ ID NO: 16914 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGTTT
gacattatcaaagttcactt

SEQ ID NO: 16915 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAACGATT
tcataagggcaaaacattcg

SEQ ID NO: 16916 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGATT
agtattcaaaagaaagaaaa

SEQ ID NO: 16917 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGATT
caaaagaaagaaaagcatga

SEQ ID NO: 16918 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
catcaaaccaaccagccgac

SEQ ID NO: 16919 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGCTT
agacatgaactctgtgatca

SEQ ID NO: 16920 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
gatcaccaggcttacaaatt

SEQ ID NO: 16921 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGCTT
caaaataactaagataatat

SEQ ID NO: 16922 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
gatcctattattaccagcat

SEQ ID NO: 16923 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
tttttgagacattctccaca

SEQ ID NO: 16924 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
aaaaggattgagaatcttta

SEQ ID NO: 16925 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
tctttaaatggtttaaatcc

SEQ ID NO: 16926 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATCGTTT
tggttctacgaaataagagc

SEQ ID NO: 16927 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
cagttaagacaaaaattagg

SEQ ID NO: 16928 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGCTT
ttctttaatcctttctttat

SEQ ID NO: 16929 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGTTT
catttgtactgctattgatc

SEQ ID NO: 16930 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGTTT
caccagtttgtctttgccac

SEQ ID NO: 16931 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGATT
tcctgtggcatttaacactc

SEQ ID NO: 16932 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGCTT
acctacctgtcatcttacac

SEQ ID NO: 16933 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
ccattcaagtacaaatgtgt

SEQ ID NO: 16934 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGCTT
atgtattaagcaggttctca

SEQ ID NO: 16935 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGTTT
ctaatcagatcatctaggga

SEQ ID NO: 16936 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGCTT
aaacatttttataaatattt

SEQ ID NO: 16937 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGTTT
acatttttacaaaaacaggc

SEQ ID NO: 16938 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGATT
tgttgacctttggtccagag

SEQ ID NO: 16939 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGTTT
tttggagttcatggacctgt

SEQ ID NO: 16940 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGATT
gaaagacaattctaactttc

SEQ ID NO: 16941 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
tacagtctatgtgacctcaa

SEQ ID NO: 16942 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGTTT
atttcctgctgccctcccta

SEQ ID NO: 16943 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGATT
tgccttgaatgcctatctgc

SEQ ID NO: 16944 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGCTT
atgcctatctgcctatgatt

SEQ ID NO: 16945 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
ggtctatgtaccactgtact

SEQ ID NO: 16946 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGTTT
cacaacacctgacacatagt

SEQ ID NO: 16947 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
tgacacatagttggtgttta

SEQ ID NO: 16948 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGCTT
caaacagagttaaatagtgg

SEQ ID NO: 16949 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGTTT
ctggcttaatcactgaagga

SEQ ID NO: 16950 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGATT
gttttgtaggggaaagttgt

SEQ ID NO: 16951 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGCTT
gtagatagaatatttttgaa

SEQ ID NO: 16952 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGATT
acactggataattaaaatag

SEQ ID NO: 16953 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
agcagagattgcagtcataa

SEQ ID NO: 16954 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGATT
taggtttgtagggataacag

SEQ ID NO: 16955 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGTTT
cacttgaggctggttaaaac

SEQ ID NO: 16956 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGTTT
caagtttcttatccccatcc

SEQ ID NO: 16957 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
gtctggggtgagatccaaga

SEQ ID NO: 16958 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGCGATT
aacctctgcctcccgggttc

SEQ ID NO: 16959 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGTTT
ttttgcatttttagtagaga

SEQ ID NO: 16960 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGTTT
atgatccgtccgtcttttta

SEQ ID NO: 16961 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGATT
ataagtaaaatacaatataa

SEQ ID NO: 16962 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGTTT
ttgagccttaaaggacagat

SEQ ID NO: 16963 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGTTT
tccatgtgtgttacaaagtt

SEQ ID NO: 16964 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGTTT
ggtagttgttattcattata

SEQ ID NO: 16965 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGCTT
gtgcaaattaagtaaactct

SEQ ID NO: 16966 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
attaagtaaactctctgagc

SEQ ID NO: 16967 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTAGTTT
tttctaatgctccttaccca

SEQ ID NO: 16968 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGATT
aacacctgatataagtaggt

SEQ ID NO: 16969 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
tgagagatgatgttaggaac

SEQ ID NO: 16970 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGATT
acttggacttcctagcacag

SEQ ID NO: 16971 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
gtcactcatttggatcattc

SEQ ID NO: 16972 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGATT
tttgacaatattagataaag

SEQ ID NO: 16973 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGATT
attagataaaggcaggatta

SEQ ID NO: 16974 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
actcataatttctacatacc

SEQ ID NO: 16975 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
attaaaaaataagaacatta

SEQ ID NO: 16976 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGATT
cttaaagctctcagtgtccg

SEQ ID NO: 16977 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGTTT
gccaagatctgagtagccaa

SEQ ID NO: 16978 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGTTT
gcctaaaaatagggtaagat

SEQ ID NO: 16979 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
gatggatgtttctgtaagga

SEQ ID NO: 16980 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
gaaataatgtaagcaaagta

SEQ ID NO: 16981 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
tatttgaatagaaatcatgc

SEQ ID NO: 16982 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
cttttcacacttttgtaatc

SEQ ID NO: 16983 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGTGATT
aactcaggtcaaaatgaagt

SEQ ID NO: 16984 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
ttaaaaaacattttgaagac

SEQ ID NO: 16985 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGATT
tgagttggggcaaattctca

SEQ ID NO: 16986 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGCTT
ttggggcaaattctcaacaa

SEQ ID NO: 16987 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
tgcttctgccctacaatttc

SEQ ID NO: 16988 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
ttagcaccaaagatctacca

SEQ ID NO: 16989 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGCTT
gaatgagagtagctgatctc

SEQ ID NO: 16990 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGCTT
acaatcaatatagatataat

SEQ ID NO: 16991 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
ccttagatctggatctataa

SEQ ID NO: 16992 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGATT
ttacgaataagttagtgact

SEQ ID NO: 16993 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
aaactgactgatgaagcggg

SEQ ID NO: 16994 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGCTT
agatgtctcactaaatgtaa

SEQ ID NO: 16995 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
taatcagaaaattttttttt

SEQ ID NO: 16996 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
ttttttttttaatgttttgc

SEQ ID NO: 16997 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
ttaatgttttgctgtggttt

SEQ ID NO: 16998 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGCTT
tcatgaatggaatatagagt

SEQ ID NO: 16999 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGGGTTT
gtgagttagatatcacaaga

SEQ ID NO: 17000 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCAGTTT
agagtgggtttattataaaa

SEQ ID NO: 17001 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCAGCTT
ggacccttcaccttagactt

SEQ ID NO: 17002 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGAGTTT
gttctccaagccactgttaa

SEQ ID NO: 17003 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
gcatattattaagactatgg

SEQ ID NO: 17004 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGTTT
tatacgcctgtactgaagaa

SEQ ID NO: 17005 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
gaagaacactgtttaatcaa

SEQ ID NO: 17006 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGCTT
atatacaacagaatcatctg

SEQ ID NO: 17007 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGATT
atcatctgtagggcttgtta

SEQ ID NO: 17008 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
tgatttgccacatccaaccc

SEQ ID NO: 17009 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGATT
gccacatccaaccccagagt

SEQ ID NO: 17010 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAACGTTT
gagttctcacctacatgtgc

SEQ ID NO: 17011 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGTTT
cacctacatgtgccaacgtt

SEQ ID NO: 17012 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGTTT
ttcaagaacaactgctgtag

SEQ ID NO: 17013 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGCTT
ctgtcagcaagaatattgtg

SEQ ID NO: 17014 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGCTT
attgtgtggagctttactct

SEQ ID NO: 17015 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTCGTTT
ctgtgctttgcattatattt

SEQ ID NO: 17016 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
taaataatatttcaaattgg

SEQ ID NO: 17017 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGATT
caaattggagttgtttatct

SEQ ID NO: 17018 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
gtgtatttgtgataatattt

SEQ ID NO: 17019 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGTTT
gagagagaccccgtcatatt

SEQ ID NO: 17020 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
aactagataacttgatatat

SEQ ID NO: 17021 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
tacatattatagaaaaaagt

SEQ ID NO: 17022 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGTGATT
tttttaacatttaatatgtt

SEQ ID NO: 17023 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGCGATT
aacctctgcctaccgggttc

SEQ ID NO: 17024 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
tgcctcagcctcctgagtag

SEQ ID NO: 17025 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGGGTTT
tttgtattttttagtagaga

SEQ ID NO: 17026 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
tgcctcggactctcaaagtg

SEQ ID NO: 17027 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
accgcgcctggccagaagcc

SEQ ID NO: 17028 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
ggccagaagccaaaagttta

SEQ ID NO: 17029 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCAGATT
taatttggtaacattttgca

SEQ ID NO: 17030 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGCTT
tcagattttactatgtatga

SEQ ID NO: 17031 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGATT
ctatgtatgatcatgcttac

SEQ ID NO: 17032 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACTGATT
aacaaatctctaaaaactat

SEQ ID NO: 17033 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGTTT
aaaaactatgactgattata

SEQ ID NO: 17034 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
ttcttccctaaacacaaagg

SEQ ID NO: 17035 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGAGATT
attctgagaaaaataagact

SEQ ID NO: 17036 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTAGTTT
ataataatgggtattgtacc

SEQ ID NO: 17037 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
ccttgatctcaccgactatt

SEQ ID NO: 17038 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
tagagacaattgtgtctcat

SEQ ID NO: 17039 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGATT
aagttaactttgtatttgta

SEQ ID NO: 17040 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
tatcatctcctacttctaaa

SEQ ID NO: 17041 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAACGATT
agaaataatttacatttgtt

SEQ ID NO: 17042 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
acctatagcctgaaaatata

SEQ ID NO: 17043 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGTTT
tgataatatgcaatagtggt

SEQ ID NO: 17044 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
caacaccaggcattggtgaa

SEQ ID NO: 17045 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGTTT
aaagcctgtggaaataatat

SEQ ID NO: 17046 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGCTT
aagtttcaatcatgcacaac

SEQ ID NO: 17047 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
aatcatgcacaacttaagct

SEQ ID NO: 17048 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTGGTTT
atgggccagctgacattttt

SEQ ID NO: 17049 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGATT
acctgatcatttccacctcc

SEQ ID NO: 17050 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
gagcctgtctttcagctctc

SEQ ID NO: 17051 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGATT
taataacagcagcaggaaag

SEQ ID NO: 17052 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGCTT
tttgctaaatgaatgactgc

SEQ ID NO: 17053 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGTGCTT
ataggcctatagaacacaga

SEQ ID NO: 17054 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGCTT
ttcatccatatattatcctt

SEQ ID NO: 17055 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGTGCTT
ttctattctctccattaatg

SEQ ID NO: 17056 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGCTT
ctccattaatgcggtgcttc

SEQ ID NO: 17057 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGCTT
taggtgagctctatctaatg

SEQ ID NO: 17058 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTACGCTT
agctctatctaatgtagggc

SEQ ID NO: 17059 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
aaggctcattgagacactga

SEQ ID NO: 17060 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGATT
acagtcatgaacttgtgcca

SEQ ID NO: 17061 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGCTT
cagattcttcttattctacg

SEQ ID NO: 17062 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGTTT
aatactctaaaattatcctt

SEQ ID NO: 17063 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAGGCTT
aatggaattgaagtgcagag

SEQ ID NO: 17064 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGATT
cagagggaggcttctagccc

SEQ ID NO: 17065 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGGGCTT
ttgaaatacaaagacaagga

SEQ ID NO: 17066 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCTGTTT
ttagtcacaaggaaaacgaa

SEQ ID NO: 17067 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGCTT
agaattcagcccacaggggt

SEQ ID NO: 17068 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGATT
aatgaccttatgtgagctct

SEQ ID NO: 17069 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAACGCTT
gctctatctgatttaggact

SEQ ID NO: 17070 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
ttcagttaccactcatttat

SEQ ID NO: 17071 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGATT
acagtgaaaagatatggtga

SEQ ID NO: 17072 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGCTT
cagtgatagctctgtcattt

SEQ ID NO: 17073 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCAGCTT
aagcaacttttaaaactgta

SEQ ID NO: 17074 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGTTT
aaaatatcataatctcacag

SEQ ID NO: 17075 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
attaaatgagaaaatctaaa

SEQ ID NO: 17076 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
acttctttttaacttttatt

SEQ ID NO: 17077 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGTTT
ttaggtttgagggtacatgt

SEQ ID NO: 17078 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGGGTTT
cataggtaaacacgtgtcat

SEQ ID NO: 17079 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGTTT
tttgctatacttttaaaaaa

SEQ ID NO: 17080 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGCTT
caacctgtctaagtacaaac

SEQ ID NO: 17081 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGATT
atctttcccttttcttcctc

SEQ ID NO: 17082 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGTTT
tgccctccccaaatgtcttc

SEQ ID NO: 17083 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
acattgcatggtagacacta

SEQ ID NO: 17084 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGCTT
atgactccaggtaaggaaaa

SEQ ID NO: 17085 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
agagcttttctgatcacatt

SEQ ID NO: 17086 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
acctaggacattcctcaggg

SEQ ID NO: 17087 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGCTT
gtctctgggacaaagagcag

SEQ ID NO: 17088 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGCTT
acaaagagcagggttgctta

SEQ ID NO: 17089 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGCTT
ctagctagatctgggctcct

SEQ ID NO: 17090 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTAGCTT
acaattaagaaaaaggttca

SEQ ID NO: 17091 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGCTT
tctctttcaactctcatgga

SEQ ID NO: 17092 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGTTT
acttttatcctaaaactacc

SEQ ID NO: 17093 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGCTT
ttccctttttataacacaca

SEQ ID NO: 17094 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGCTT
caagatgcttcacaagctga

SEQ ID NO: 17095 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGTTT
tcccaccacacttgcagttc

SEQ ID NO: 17096 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
ttaatttcctgaatatctga

SEQ ID NO: 17097 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTACGATT
tgatgctgttttatgcctcc

SEQ ID NO: 17098 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTACGTTT
tagaccctgaaaagcaccat

SEQ ID NO: 17099 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
agaactttgtcacatttaca

SEQ ID NO: 17100 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGCTT
tctgcaagactgactgttga

SEQ ID NO: 17101 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
gctgcttgttgtaacttgaa

SEQ ID NO: 17102 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
aacttgaaattagttttatc

SEQ ID NO: 17103 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGCTT
aacgactgttgctcgccagt

SEQ ID NO: 17104 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGCTT
ctctctttgttctacaggga

SEQ ID NO: 17105 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGTTT
tgttctacagggaaagtgct

SEQ ID NO: 17106 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGTTT
gtttatgccacagactctct

SEQ ID NO: 17107 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGATT
tttgtcattggcactaatca

SEQ ID NO: 17108 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
gagcaggatcatgaggacaa

SEQ ID NO: 17109 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGTTT
ctgtgttcaacaatcttgta

SEQ ID NO: 17110 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGATT
gcaggttttcctgatgttcc

SEQ ID NO: 17111 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGCTT
ttaatacattatttaatgca

SEQ ID NO: 17112 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGATT
cacctatacttgcaatttca

SEQ ID NO: 17113 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGTTT
cttcatcttctaactttgca

SEQ ID NO: 17114 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTAGTTT
tgttttctaaatagttgtta

SEQ ID NO: 17115 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGCTT
ctaaatagttgttagttagt

SEQ ID NO: 17116 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
ttaagttcaaaagaaactca

SEQ ID NO: 17117 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
tgattagaagatccagatga

SEQ ID NO: 17118 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
aaaattgtacttaaaaatgg

SEQ ID NO: 17119 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
ttttatgtattcacctctgt

SEQ ID NO: 17120 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
ctttcctcagtgaatttatg

SEQ ID NO: 17121 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGCTT
catggaagaaatcaatctca

SEQ ID NO: 17122 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGCTT
cttgagaaagagagatcagt

SEQ ID NO: 17123 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
gaatcaaaatatcagtaaaa

SEQ ID NO: 17124 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGTTT
tgttatgcatagaaatttaa

SEQ ID NO: 17125 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGAGCTT
acaagaggcaagggtgagag

SEQ ID NO: 17126 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCAGATT
aggtgagcttagaaaaattg

SEQ ID NO: 17127 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGTTT
aagcattggcctttacctta

SEQ ID NO: 17128 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
ttggcctttaccttaaggag

SEQ ID NO: 17129 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
tagagaggagtaggggtgaa

SEQ ID NO: 17130 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGATT
gtttcatacccagaaaacca

SEQ ID NO: 17131 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGATT
tccagtatcctgtctggagg

SEQ ID NO: 17132 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGATT
tagttaggaactagagttgt

SEQ ID NO: 17133 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGATT
atatttggcagataaaatca

SEQ ID NO: 17134 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGATT
cagataaaatcagcaggatt

SEQ ID NO: 17135 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGATT
taaaatcagcaggatttggt

SEQ ID NO: 17136 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGATT
ggaggagctgactcggcagg

SEQ ID NO: 17137 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
atgattttgagatgcctgtg

SEQ ID NO: 17138 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGATT
ttgtttaaatacagatatcc

SEQ ID NO: 17139 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
catgtatctgctgaagtcag

SEQ ID NO: 17140 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGCTT
gttgttaaactgtcagaaat

SEQ ID NO: 17141 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCCGTTT
tactgtattttatttgtcta

SEQ ID NO: 17142 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTGGATT
ctggacggtggtctattctc

SEQ ID NO: 17143 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGTTT
gcatttagcaatttcacatc

SEQ ID NO: 17144 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGCTT
aatctccaagcactacaaat

SEQ ID NO: 17145 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
aagcactacaaatgagagct

SEQ ID NO: 17146 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
agataaacagtcaaggtgta

SEQ ID NO: 17147 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
atatcctttcattattgaaa

SEQ ID NO: 17148 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
ttcattattgaaattctgtt

SEQ ID NO: 17149 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
ctgttttttgatttgcaaat

SEQ ID NO: 17150 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
gaatgagtaaagttctgaca

SEQ ID NO: 17151 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGTTT
agtcttcatgctaaaactat

SEQ ID NO: 17152 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aataggttgcctatacatgc

SEQ ID NO: 17153 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGTTT
ttttttattttccttggaga

SEQ ID NO: 17154 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aaaagagaaaccaaagagta

SEQ ID NO: 17155 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
acataagaggcccagaaaga

SEQ ID NO: 17156 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
ttgaaaaattttaatcaatt

SEQ ID NO: 17157 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGTTT
atgggcagcacttttttgat

SEQ ID NO: 17158 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGTTT
acttttttgatacctgtttc

SEQ ID NO: 17159 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
tttgaattttagatatttct

SEQ ID NO: 17160 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
atataattcattaacaagta

SEQ ID NO: 17161 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
gacaagatgcacctggtaga

SEQ ID NO: 17162 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
atgttttgtaatgaatcttt

SEQ ID NO: 17163 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGTTT
ctatagaaatacagcaaaca

SEQ ID NO: 17164 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGTTT
tccctctccccctatgtctc

SEQ ID NO: 17165 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGTTT
atcatgtatattttatgtgt

SEQ ID NO: 17166 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGTTT
tgttcctgttttttctctct

SEQ ID NO: 17167 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGCTT
gaagactcaaactgagtctg

SEQ ID NO: 17168 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGCTT
gagtctgtaatgcttgctct

SEQ ID NO: 17169 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGCTT
gtactcatcatagtcctcta

SEQ ID NO: 17170 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
tggcttaataggtcatttat

SEQ ID NO: 17171 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGATT
ttatagttgatttttaaaag

SEQ ID NO: 17172 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGCTT
aggtgaatggaaaatctaca

SEQ ID NO: 17173 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGCTT
tgaattttttaatattaact

SEQ ID NO: 17174 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
gaaaattatccctttggtta

SEQ ID NO: 17175 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
ggttaagaagattttgctct

SEQ ID NO: 17176 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGATT
attgaagggaaacattattc

SEQ ID NO: 17177 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
agtaaactttcaatctgaaa

SEQ ID NO: 17178 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGGGTTT
agtttcataaatattgccct

SEQ ID NO: 17179 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGTTT
tcagggtttattacacctca

SEQ ID NO: 17180 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTGGTTT
caagagtgatggagcgcctg

SEQ ID NO: 17181 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
tttgtgcaaaggtatatccc

SEQ ID NO: 17182 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGTTT
agtaaatgctatttcttttg

SEQ ID NO: 17183 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGTTT
tgcattacataaagtctatg

SEQ ID NO: 17184 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
atcaatataattaatttaaa

SEQ ID NO: 17185 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGCTT
tttaaaaattgattatgaaa

SEQ ID NO: 17186 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGATT
tacaaaacattttgaaagga

SEQ ID NO: 17187 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
acattttgaaaggaagatga

SEQ ID NO: 17188 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGCGATT
aacctctgcctcctgggttc

SEQ ID NO: 17189 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACGGGATT
tttttgtatttttagtagaa

SEQ ID NO: 17190 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGATT
ttatttttcgctaactctaa

SEQ ID NO: 17191 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATCGTTT
tgtgagactatgaacaacaa

SEQ ID NO: 17192 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGATT
tcttcagtaaaaacatgcta

SEQ ID NO: 17193 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGATT
gaaacattgctctgaactgg

SEQ ID NO: 17194 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
caacttgtaagtaaacatgt

SEQ ID NO: 17195 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGCTT
gattcttcattctgacaagc

SEQ ID NO: 17196 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGTTT
tcatgtggaaactatgcatt

SEQ ID NO: 17197 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGATT
taagctcccatcacctctca

SEQ ID NO: 17198 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGCTT
gcagaaactccaagaaatct

SEQ ID NO: 17199 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
tgctattcgcccttccactc

SEQ ID NO: 17200 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGAGATT
cactcttaagattgcacatt

SEQ ID NO: 17201 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
cactttttaaaaataatgtc

SEQ ID NO: 17202 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
aaaataatgtcatttgtttt

SEQ ID NO: 17203 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
taatgtcatttgttttattt

SEQ ID NO: 17204 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGATT
gctcactgcaacctctgcct

SEQ ID NO: 17205 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
tgcctcagcctcacaagtag

SEQ ID NO: 17206 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGTTT
tttttcattttcagtaaaaa

SEQ ID NO: 17207 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGTTT
ttctccatctattttggcct

SEQ ID NO: 17208 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGCTT
aagaaacgccacctttatag

SEQ ID NO: 17209 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
atctgacctgctacatcttg

SEQ ID NO: 17210 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
tatgtttcttcagcaagggg

SEQ ID NO: 17211 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
cacacaggtatttaataatt

SEQ ID NO: 17212 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
tatttgtttactggaataaa

SEQ ID NO: 17213 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGCTT
gttgaaaggctaagcaaatt

SEQ ID NO: 17214 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
aagcccaggttcattggaaa

SEQ ID NO: 17215 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGTTT
aatatttcttctatactggc

SEQ ID NO: 17216 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGTTT
attcacaaaagtattttcat

SEQ ID NO: 17217 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGATT
aagtattttcattgatgttt

SEQ ID NO: 17218 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
atagtattaatactttctgt

SEQ ID NO: 17219 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGTTT
ttaatactttctgtaagagt

SEQ ID NO: 17220 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
taagttttttgaagtcattt

SEQ ID NO: 17221 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
ttttttggtttgaaacttta

SEQ ID NO: 17222 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
acttttaaaggaaactgtgc

SEQ ID NO: 17223 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
attgactggatgtcgtacac

SEQ ID NO: 17224 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGTTT
aagaaaatccatgcactctt

SEQ ID NO: 17225 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
atgtctttattttccaatca

SEQ ID NO: 17226 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGATGATT
cttggacactgaaagcaagt

SEQ ID NO: 17227 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
tgtgctatcataacttctgt

SEQ ID NO: 17228 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
ggaagataggcactgtgcta

SEQ ID NO: 17229 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGATT
acagatgagatatctgaaga

SEQ ID NO: 17230 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
ataagtcggcaaattagaac

SEQ ID NO: 17231 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGTTT
aacatatgtttatcaggctc

SEQ ID NO: 17232 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGCTT
tattacattgcagccctact

SEQ ID NO: 17233 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGATT
tcagactttaccctagaggc

SEQ ID NO: 17234 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGCTT
gtgtgcatgcaaatcctctt

SEQ ID NO: 17235 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGCTT
tttaagggtctctcaaagtc

SEQ ID NO: 17236 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
gaggaagctgtaaaccatac

SEQ ID NO: 17237 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
agctgtaaaccatactaaag

SEQ ID NO: 17238 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
aaaccatactaaagttttgt

SEQ ID NO: 17239 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
tactaaagttttgtttttgt

SEQ ID NO: 17240 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
aaaaaaacttattaaacttg

SEQ ID NO: 17241 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGCTT
ttaagagtcaatagcacaga

SEQ ID NO: 17242 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGCTT
caggcatgcatgaaacacct

SEQ ID NO: 17243 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGATT
tcagaataagaaaagataac

SEQ ID NO: 17244 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
gactgtagtcaacagtatca

SEQ ID NO: 17245 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGATT
cagttttctgagagttagtg

SEQ ID NO: 17246 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
agttagtgagtagattccat

SEQ ID NO: 17247 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGCTT
ctctaaaataagaagtagta

SEQ ID NO: 17248 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGCTT
agtgccatagatgtggaaac

SEQ ID NO: 17249 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGCTT
tcggaattcataggttcagc

SEQ ID NO: 17250 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGCTT
atcaactgtgctgcactctg

SEQ ID NO: 17251 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCGGTTT
gctgcactctgaggagcttg

SEQ ID NO: 17252 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
ctcatgcaaagtattatgaa

SEQ ID NO: 17253 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
ctgtaaaataataaacttta

SEQ ID NO: 17254 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACGGTTT
atcaagaccacaaaatcaaa

SEQ ID NO: 17255 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGTTT
tataagtgatcataacgcaa

SEQ ID NO: 17256 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGCTT
gcaaataggtttttctcacc

SEQ ID NO: 17257 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGTTT
cagagctttatgagtaacca

SEQ ID NO: 17258 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
actctgtcaaatttcccaaa

SEQ ID NO: 17259 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
taaaatacttatttcagata

SEQ ID NO: 17260 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
ttaatatgatagcccaatct

SEQ ID NO: 17261 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGATT
caatctaaaggtttgacttt

SEQ ID NO: 17262 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGTTT
gcattattcccaccaggtcc

SEQ ID NO: 17263 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
accaggtccaggagtttgat

SEQ ID NO: 17264 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGATT
actcaaaaacatgttattta

SEQ ID NO: 17265 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
aactgattgaattcatctaa

SEQ ID NO: 17266 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGCTT
atattctataaaactataga

SEQ ID NO: 17267 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
tttaaagtataaactataga

SEQ ID NO: 17268 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGTTT
tagaatgagttttaaaatat

SEQ ID NO: 17269 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
aaaatatataagttttaaaa

SEQ ID NO: 17270 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGTTT
aagtaccatatttagaagac

SEQ ID NO: 17271 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGCTT
atttagaagactacagtttt

SEQ ID NO: 17272 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGTTT
ctgaaaaaagaattattggc

SEQ ID NO: 17273 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
taacaataggaaatagttat

SEQ ID NO: 17274 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
ctggtaacaacttttaaata

SEQ ID NO: 17275 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
agcatcttcaaacatcaata

SEQ ID NO: 17276 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGTTT
acatcaataattggttttct

SEQ ID NO: 17277 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGATT
actgtttaagagagcattaa

SEQ ID NO: 17278 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGATT
ttaacaaagatttatgccaa

SEQ ID NO: 17279 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACGTGATT
ttatgagcaagtaaaaattc

SEQ ID NO: 17280 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGTTT
gttgaaactttttttcatat

SEQ ID NO: 17281 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
ctttttttcatatgcaggtt

SEQ ID NO: 17282 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGCTT
ttttttaatggtcaattgaa

SEQ ID NO: 17283 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
acagacaaattattatggct

SEQ ID NO: 17284 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
ctaatagattcttagacatt

SEQ ID NO: 17285 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
tccatactgtatataaaatt

SEQ ID NO: 17286 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGCTT
ataaaattaaatgtttataa

SEQ ID NO: 17287 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGCTT
aaatctatacttgctacagt

SEQ ID NO: 17288 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGATT
gctacagtataagcttcttt

SEQ ID NO: 17289 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
agaaaggctgatatatataa

SEQ ID NO: 17290 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
catatttaagtactttgaat

SEQ ID NO: 17291 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGATT
tcaattatttgtattatttt

SEQ ID NO: 17292 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
tttctttaaactcaatcatc

SEQ ID NO: 17293 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
ttaaactcaatcatctgttg

SEQ ID NO: 17294 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
ctatattagagaagtgaaat

SEQ ID NO: 17295 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGATT
aggaccttctgtaattttca

SEQ ID NO: 17296 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
cttctgtaattttcacatgg

SEQ ID NO: 17297 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
atattgactgtgccttctaa

SEQ ID NO: 17298 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGATT
aaaagttccctccactatct

SEQ ID NO: 17299 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
tagctgtgaaacaatcctta

SEQ ID NO: 17300 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGCTT
actgaaaatatgtccaaatt

SEQ ID NO: 17301 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
ttaaaagctttattattctt

SEQ ID NO: 17302 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGATT
attattcttcatggttttcc

SEQ ID NO: 17303 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
tccctttgattgccttgaag

SEQ ID NO: 17304 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGCTT
tgaagctgtgttttctacta

SEQ ID NO: 17305 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
acaaaaaccttactcaaaga

SEQ ID NO: 17306 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
catttcaagtacatactata

SEQ ID NO: 17307 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGCTT
tcaagtacatactataaact

SEQ ID NO: 17308 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
agcaagaaagacattttaaa

SEQ ID NO: 17309 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGTTT
tccatcttttaatttaattg

SEQ ID NO: 17310 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGTTT
gcataagagtccaatatttt

SEQ ID NO: 17311 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGTTT
cattatgttacaggacaact

SEQ ID NO: 17312 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGTTT
atgtgaacattatcctctta

SEQ ID NO: 17313 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGCTT
aatattattgatattactat

SEQ ID NO: 17314 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
gagtgtaatcacatttctta

SEQ ID NO: 17315 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
aatcacatttcttaacatga

SEQ ID NO: 17316 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGATT
tttttttgatatgaaatttc

SEQ ID NO: 17317 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGTTT
actgtattttcttctgttgt

SEQ ID NO: 17318 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCAGTTT
cactaatttagcagaaaatt

SEQ ID NO: 17319 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGATT
agagaaattcagaataaaac

SEQ ID NO: 17320 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
tgtaagaaggctagactggc

SEQ ID NO: 17321 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGTTT
gctctgtcacagaactgcta

SEQ ID NO: 17322 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCAGCTT
taaacaattttgctatttat

SEQ ID NO: 17323 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGATT
aaatgcaacaagtaggtaaa

SEQ ID NO: 17324 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGCTT
caaagtgtagatacgcagac

SEQ ID NO: 17325 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGCTT
ttttaatgaatggaataatt

SEQ ID NO: 17326 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGATT
aattactagctttttaaaca

SEQ ID NO: 17327 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCAGCTT
ataactatatcctttatgta

SEQ ID NO: 17328 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGTTT
aagtcattcttaactgaata

SEQ ID NO: 17329 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGCTT
acatgtacctcatcttttct

SEQ ID NO: 17330 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
aattcaaaacatatatatgc

SEQ ID NO: 17331 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGCTT
catgtatatatatttctaga

SEQ ID NO: 17332 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
aaatagctttctcaaaaatt

SEQ ID NO: 17333 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
ttcaccatattctggaataa

SEQ ID NO: 17334 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
aaggtgtgtcaatttcagga

SEQ ID NO: 17335 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
gtgtcaatttcaggataaag

SEQ ID NO: 17336 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
cagagaaattcaaaatatga

SEQ ID NO: 17337 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGATT
aactagattataaaaaggag

SEQ ID NO: 17338 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGATT
ggagtcaagattcttattgg

SEQ ID NO: 17339 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGATT
gttctatgtgttattgatag

SEQ ID NO: 17340 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGTTT
aatatgctctatctaaacct

SEQ ID NO: 17341 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGATT
ctcttagtttctagagactg

SEQ ID NO: 17342 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
aaatcaaatgttaattactg

SEQ ID NO: 17343 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGTTT
aaaccatttcaaaatgtatt

SEQ ID NO: 17344 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
ttatactagaagcagggtac

SEQ ID NO: 17345 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
ctaagaaagcatgagtctca

SEQ ID NO: 17346 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGATT
tacaatgatcttttcctgct

SEQ ID NO: 17347 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGTTT
acacttcttccacaattttt

SEQ ID NO: 17348 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
tacatctctccatattttta

SEQ ID NO: 17349 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGTTT
aatcaggaagggaagttgat

SEQ ID NO: 17350 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGCTT
atagaggttttcaaattaaa

SEQ ID NO: 17351 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
tttatctattgaacaactgt

SEQ ID NO: 17352 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
tcttgcagtgggtcaggcag

SEQ ID NO: 17353 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
acattgaaaaaatatcgtat

SEQ ID NO: 17354 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGTTT
agagctgcatccttgactga

SEQ ID NO: 17355 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
ttagaaatgcagcatgatga

SEQ ID NO: 17356 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
tgatgaaagagtttagtcaa

SEQ ID NO: 17357 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
gtttagtcaactgtgtttta

SEQ ID NO: 17358 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
aatatatttgaatcacagta

SEQ ID NO: 17359 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
aatactataatgtgctaatg

SEQ ID NO: 17360 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
tgcaagcaacatttaaatat

SEQ ID NO: 17361 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGCTT
gtgaggtggcagtaagagta

SEQ ID NO: 17362 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
catattctaaaattagcatt

SEQ ID NO: 17363 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
taaacagcattgcaaaaaag

SEQ ID NO: 17364 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGATT
aaaatataaagaataagaca

SEQ ID NO: 17365 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
aatatgtcagacaaatattt

SEQ ID NO: 17366 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGATT
aaacaaatccaatgaagatg

SEQ ID NO: 17367 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGCTT
ctaagtgcaattctacagaa

SEQ ID NO: 17368 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
tcaaagtcaaatgcattttt

SEQ ID NO: 17369 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGATT
agcagaaggtaaatctaaaa

SEQ ID NO: 17370 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGCTT
gtgaatcaggtgaacaatat

SEQ ID NO: 17371 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGATT
atgaatgcttgttcctctgc

SEQ ID NO: 17372 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGTTT
actcaatgcatcctcaatgg

SEQ ID NO: 17373 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACGGATT
ggactagtttagtgtcctgt

SEQ ID NO: 17374 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGCTT
gtttagtgtcctgttacgga

SEQ ID NO: 17375 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
gtgtcctgttacggattgtg

SEQ ID NO: 17376 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
ccctttacctttgaagtaca

SEQ ID NO: 17377 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
gaagtacatgaagtttttag

SEQ ID NO: 17378 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
aatatttatgtaattaagaa

SEQ ID NO: 17379 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
ataagattatacaggtagaa

SEQ ID NO: 17380 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGTTT
atgttgagccacatgaaatt

SEQ ID NO: 17381 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGATT
cacatgaaatttctagtttt

SEQ ID NO: 17382 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
agattaaaaatggttggata

SEQ ID NO: 17383 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
ttcaataagtaaaaattaac

SEQ ID NO: 17384 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
ttttttggtaattttataca

SEQ ID NO: 17385 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGATT
aaggtatcttaccaagagaa

SEQ ID NO: 17386 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
agttggataaggatctctgg

SEQ ID NO: 17387 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGCTT
gcaagtgggatagtcattac

SEQ ID NO: 17388 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGATT
tatagaagaaaaaacacatg

SEQ ID NO: 17389 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGTTT
cacgtggactgctgatctgt

SEQ ID NO: 17390 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGATT
aaaacacacacacaaaaaaa

SEQ ID NO: 17391 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGTTT
cccatgtacccttaagtaaa

SEQ ID NO: 17392 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
gtgtagaaaaaattatgcca

SEQ ID NO: 17393 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGCTT
ataataagtcatgacaaagg

SEQ ID NO: 17394 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGTTT
gaacctcatagttacctcag

SEQ ID NO: 17395 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
agaacttgaatttggtctag

SEQ ID NO: 17396 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGTTT
aaatatattctagaagtaaa

SEQ ID NO: 17397 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGTTT
ttcaataaagaagggaataa

SEQ ID NO: 17398 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGATT
acctaatcagtcagcattaa

SEQ ID NO: 17399 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGATT
cctttctatggcatgtagta

SEQ ID NO: 17400 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGCTT
atggcatgtagtataatgat

SEQ ID NO: 17401 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGTTT
gtagtataatgattacagct

SEQ ID NO: 17402 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCGTGCTT
cattttatccgtgtgtgtgt

SEQ ID NO: 17403 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
cttttgcatccacctctcaa

SEQ ID NO: 17404 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGCTT
gctctaaggcactgtccaca

SEQ ID NO: 17405 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGCTT
gccttatcgtggcagaaggg

SEQ ID NO: 17406 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGCTT
ggagaagaaaggcctgaccc

SEQ ID NO: 17407 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
agaaaggcctgaccctcttg

SEQ ID NO: 17408 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTACGTTT
tgcctcactttttacagatg

SEQ ID NO: 17409 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGATT
gaaaacacttctcagtaaat

SEQ ID NO: 17410 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGATT
gtaaatctcagatttctctc

SEQ ID NO: 17411 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
tctcagatttctctctcagg

SEQ ID NO: 17412 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCGTGATT
gaactgacccctacacaatc

SEQ ID NO: 17413 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
ctctgacttttcttctttcc

SEQ ID NO: 17414 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGTTT
atgttgaagtcctaaccctg

SEQ ID NO: 17415 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGATT
aaactacgtgagtaccgggc

SEQ ID NO: 17416 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGATT
gatgatgcagctgcaagctg

SEQ ID NO: 17417 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGATT
aaatcatggccttgctcaga

SEQ ID NO: 17418 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGTTT
atttctgttgttgtaagcca

SEQ ID NO: 17419 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGCTT
tccctcagcaattcttagca

SEQ ID NO: 17420 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGCTT
ggtgcatttcatacttcctt

SEQ ID NO: 17421 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
aagcctgtgtagtgtgttgt

SEQ ID NO: 17422 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGTGCTT
gtgtgttgttaatgtttgga

SEQ ID NO: 17423 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGGGCTT
taatgtttggagtgtgcttg

SEQ ID NO: 17424 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
ttgagataacagcatgtctt

SEQ ID NO: 17425 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
agtgctattgttctatttcc

SEQ ID NO: 17426 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
atttccatttgtttcctcag

SEQ ID NO: 17427 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACCGTTT
ctgtttaagatatttgacta

SEQ ID NO: 17428 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
ttaagatatttgactaaacc

SEQ ID NO: 17429 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGTTT
tctttggttattttctgata

SEQ ID NO: 17430 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
agaggttttactgtaaaata

SEQ ID NO: 17431 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
ttttactgtaaaatattttg

SEQ ID NO: 17432 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGGGTTT
ggatgctaggtcataaaaga

SEQ ID NO: 17433 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGTTT
ggagagatatcaaaggtcag

SEQ ID NO: 17434 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGATT
aaacctgaatccaagtaagc

SEQ ID NO: 17435 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGTTT
catatttatggggtacatgt

SEQ ID NO: 17436 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGCTT
aatagggtaactagcagatc

SEQ ID NO: 17437 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAACGATT
tatggttaactctagtcatc

SEQ ID NO: 17438 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGCTT
acttattctttctatctcac

SEQ ID NO: 17439 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
atctacttctatgacaaccc

SEQ ID NO: 17440 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGATT
atatttgactttctgtgcct

SEQ ID NO: 17441 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAGGATT
cattcatgttgccacaaata

SEQ ID NO: 17442 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGTTT
acatataggagtacagtatt

SEQ ID NO: 17443 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
tttactgtatctcttcaaca

SEQ ID NO: 17444 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGATT
acattctcacaatcagtgtg

SEQ ID NO: 17445 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
atcctttaaacacttatatc

SEQ ID NO: 17446 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGTTT
gggtgaggagatacctcaag

SEQ ID NO: 17447 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGATT
gaggagatacctcaagatag

SEQ ID NO: 17448 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGATT
aggtttgatttgcatttccc

SEQ ID NO: 17449 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
cttttgtccatttttgaatt

SEQ ID NO: 17450 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
tgttttttttgtcgttgttg

SEQ ID NO: 17451 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
ttgagttgtttgagttcctt

SEQ ID NO: 17452 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGTTT
tattaacccattatcagatg

SEQ ID NO: 17453 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
tgtaggttatctcttcactc

SEQ ID NO: 17454 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGTTT
ggttatctcttcactctatt

SEQ ID NO: 17455 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGCTT
gattgtttgccttgctgtgc

SEQ ID NO: 17456 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
gccttgctgtgcagaagctt

SEQ ID NO: 17457 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
atataatccaatttgtctat

SEQ ID NO: 17458 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGCTT
tctatatttgcttttgttgc

SEQ ID NO: 17459 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
gcttttgttgcctgtgcttt

SEQ ID NO: 17460 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
ccttgcctagaacaacatca

SEQ ID NO: 17461 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGTTT
acaacatcatgaagctttcc

SEQ ID NO: 17462 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGTTT
tttttcttctctaatagttg

SEQ ID NO: 17463 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGTTT
cattcttttgcatgtggcta

SEQ ID NO: 17464 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
aactcagttgactgtatatg

SEQ ID NO: 17465 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGTTT
tcttatgtattgctctgtgt

SEQ ID NO: 17466 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
tctgttttatgtcagtatca

SEQ ID NO: 17467 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
gtatcattctgtttggttac

SEQ ID NO: 17468 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
ttggttactatagctttata

SEQ ID NO: 17469 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGCTT
aagtcagttagtgtgaagcc

SEQ ID NO: 17470 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
ttgggctatttagggtcttt

SEQ ID NO: 17471 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGATT
gaatgtcactggtattttga

SEQ ID NO: 17472 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
gatagggattgcattaaacc

SEQ ID NO: 17473 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGCTT
gggattgcattaaacctgta

SEQ ID NO: 17474 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
aatttctctcaccaatattt

SEQ ID NO: 17475 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGTTT
attgtaaatatatttcacct

SEQ ID NO: 17476 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGATT
attttttgtagctattgtaa

SEQ ID NO: 17477 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGCTT
tttgtagctattgtaaatgg

SEQ ID NO: 17478 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGATT
aatgggattgctttcttatt

SEQ ID NO: 17479 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
ttgttaacatatagaaataa

SEQ ID NO: 17480 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGATT
aaataatattgatttttgca

SEQ ID NO: 17481 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCTGATT
gtcctttatttctttctctt

SEQ ID NO: 17482 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGCTT
cttgttccagatcttggaga

SEQ ID NO: 17483 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGGGTTT
tggttagtatcatgttagct

SEQ ID NO: 17484 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
atggccttcattacattaag

SEQ ID NO: 17485 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGATT
atttttatcaaataaaggat

SEQ ID NO: 17486 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
aaaggatactggattttata

SEQ ID NO: 17487 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGATT
tgctttttctctgtctattg

SEQ ID NO: 17488 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGTTT
tctgtctattgagatgatta

SEQ ID NO: 17489 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
ttgagatgattatatggttt

SEQ ID NO: 17490 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
cattctgttgatataatata

SEQ ID NO: 17491 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGACGATT
gaaacatctttgcatccctg

SEQ ID NO: 17492 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGATT
aataatctttttgataggct

SEQ ID NO: 17493 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGCTT
gttcatcagggatagtggcc

SEQ ID NO: 17494 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
atttagaagaattcctttcc

SEQ ID NO: 17495 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
attagtattagttcttcttt

SEQ ID NO: 17496 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGATT
cctggacttttctttgctag

SEQ ID NO: 17497 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
tttgctaggagagattttat

SEQ ID NO: 17498 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGTTT
aatcttgttactcattattg

SEQ ID NO: 17499 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
gttactcattattggtctgt

SEQ ID NO: 17500 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
gagtaatttatcaatttcca

SEQ ID NO: 17501 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
aggttttccaatttgttgga

SEQ ID NO: 17502 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGATT
gtagctgctgcaaacgttgt

SEQ ID NO: 17503 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
acacataaataaactgaaaa

SEQ ID NO: 17504 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
gctcaaggtcttatcaaaag

SEQ ID NO: 17505 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGATT
ctgggaactcaagtgggaga

SEQ ID NO: 17506 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAGGATT
gagcaggaaaagttagcata

SEQ ID NO: 17507 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGTTT
ggaaagaaagaccttagatg

SEQ ID NO: 17508 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGCTT
gtaaggtttttatagttgac

SEQ ID NO: 17509 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAGGTTT
ctcaattcttatattttcag

SEQ ID NO: 17510 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGCTT
acaacaaacactttttttaa

SEQ ID NO: 17511 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGCTT
atgctacatgacttaaaaat

SEQ ID NO: 17512 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
aatattagaatattaacatc

SEQ ID NO: 17513 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGTTT
atcaaatgatttttagacaa

SEQ ID NO: 17514 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
gacaactcagtttatagggc

SEQ ID NO: 17515 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATACGCTT
tttatagggcactagatttc

SEQ ID NO: 17516 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGCTT
atatataaattctatagctg

SEQ ID NO: 17517 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
caaattattaagtccaatag

SEQ ID NO: 17518 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
ttattaagtccaataggaat

SEQ ID NO: 17519 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
gtccaataggaatgtttgtt

SEQ ID NO: 17520 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGATT
taactgtataactctataac

SEQ ID NO: 17521 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGCTT
tagatttataactgtataac

SEQ ID NO: 17522 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGCTT
aaatcacttccttttaatga

SEQ ID NO: 17523 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGCTT
ttgactttccccagctcctg

SEQ ID NO: 17524 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGTTT
agtgctttaacacctagaat

SEQ ID NO: 17525 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGTTT
gcaactgtctgccaggcaat

SEQ ID NO: 17526 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTAGTTT
agaaaaaaataggtgactga

SEQ ID NO: 17527 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGATT
ccttaaaaggcatacgtgga

SEQ ID NO: 17528 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACGGTTT
taactttaagctgaaatgaa

SEQ ID NO: 17529 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGATT
aacaaatatttacattgtgt

SEQ ID NO: 17530 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAGGTTT
gtacatatgagaggatgtgt

SEQ ID NO: 17531 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGATT
atataaaggaattgagcatc

SEQ ID NO: 17532 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
cccatagatatcgagggatg

SEQ ID NO: 17533 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
agatatcgagggatgactag

SEQ ID NO: 17534 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
tggctacatagaaacatata

SEQ ID NO: 17535 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
atatagagcattttatttta

SEQ ID NO: 17536 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
gtatttaatttaatcttatg

SEQ ID NO: 17537 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGCTT
ctggagtgcagcggtgcgat

SEQ ID NO: 17538 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
aacctccgcctctggagctc

SEQ ID NO: 17539 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
tatatatatatatatatcag

SEQ ID NO: 17540 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTCGTTT
gtcatgattattccatataa

SEQ ID NO: 17541 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
taacatgagctagagaaaac

SEQ ID NO: 17542 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
tgggagaggagggcacaaaa

SEQ ID NO: 17543 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
atttctcaaaaaattaaaat

SEQ ID NO: 17544 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
gaatccaggaagaagtataa

SEQ ID NO: 17545 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGCGATT
ttcatttaaccctgacccaa

SEQ ID NO: 17546 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGATT
aaatacaagggtgatgcctt

SEQ ID NO: 17547 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGTTT
aatcccaagcaaagtgtgga

SEQ ID NO: 17548 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
tgtttatgacctaaaaggaa

SEQ ID NO: 17549 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGCTT
gctggttagggccatagtgt

SEQ ID NO: 17550 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
gtaatctcagcaactgggga

SEQ ID NO: 17551 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGTTT
ttgaagaattgcctgagtcc

SEQ ID NO: 17552 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCCGTTT
ggcaacagagtgagacctgt

SEQ ID NO: 17553 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
atggatacatcatgagagtg

SEQ ID NO: 17554 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGCTT
agcagaggcatcagttgaga

SEQ ID NO: 17555 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
tcagttgagactctgcttga

SEQ ID NO: 17556 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGATT
gaaaggtgatgaaaaggaga

SEQ ID NO: 17557 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGCTT
gggaaggctcaaagatacct

SEQ ID NO: 17558 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGATT
gagctttctcatacagctaa

SEQ ID NO: 17559 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCGGATT
tcagcattcatattttccaa

SEQ ID NO: 17560 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
ttggcactgtcactgtgagg

SEQ ID NO: 17561 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
gtgaggctgggattgtgaat

SEQ ID NO: 17562 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
gaccatcactgtcttccatc

SEQ ID NO: 17563 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGCTGCTT
ttccatcaagtgtttgtcca

SEQ ID NO: 17564 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGATT
gtccacgctgcttccaaaac

SEQ ID NO: 17565 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
agcaagtgtatggttagaaa

SEQ ID NO: 17566 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGCTT
tccttcttagtattcagatc

SEQ ID NO: 17567 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
gtcttatctccctggaaatc

SEQ ID NO: 17568 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
gaaatctttggctttttgga

SEQ ID NO: 17569 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGTTT
gcttttagaataaattcacg

SEQ ID NO: 17570 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
ttagaataaattcacgtaag

SEQ ID NO: 17571 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGTTT
tctagtcactgcaatctgga

SEQ ID NO: 17572 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGATT
cagggtcttcttcaattgct

SEQ ID NO: 17573 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGTTT
gctcaataataaggccagaa

SEQ ID NO: 17574 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGAAGATT
gccacaatacaaaccagcaa

SEQ ID NO: 17575 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGCTT
gtccaagaagcgtgctagaa

SEQ ID NO: 17576 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGATT
gaaaaggacctgccccttga

SEQ ID NO: 17577 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGATT
attcacatgcaataatggca

SEQ ID NO: 17578 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGCTT
caataatggcattatgattg

SEQ ID NO: 17579 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
ttggctggcttcattgccta

SEQ ID NO: 17580 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
gcctattatgtttgccctag

SEQ ID NO: 17581 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGTTT
caatttctattctcttgaag

SEQ ID NO: 17582 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
aattgtaaattatatttaaa

SEQ ID NO: 17583 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
catggcccaaatcatctacc

SEQ ID NO: 17584 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGATT
aaaattgtgtgtctcaataa

SEQ ID NO: 17585 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
taattgctaaaaatccctga

SEQ ID NO: 17586 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGTTT
agtatatttcactatgaaat

SEQ ID NO: 17587 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
tgaaatacatgtttgtgtat

SEQ ID NO: 17588 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGCTT
gaagatctgagggtccattt

SEQ ID NO: 17589 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGATT
gaaatattaataaaatgtat

SEQ ID NO: 17590 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
atacttgattcaaagtctca

SEQ ID NO: 17591 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAAGTTT
cattttgattaatggtcttc

SEQ ID NO: 17592 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
tgactaaaacttatttttcc

SEQ ID NO: 17593 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCAGTTT
agaaatataaaaaaagagaa

SEQ ID NO: 17594 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGTTT
aacactcaccaatatatccc

SEQ ID NO: 17595 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGATT
cctaataagcatcttaaaaa

SEQ ID NO: 17596 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
caaggattagaccatgggta

SEQ ID NO: 17597 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGATT
ataataaacatttaaattat

SEQ ID NO: 17598 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGCTT
catttaaattatttgtgatt

SEQ ID NO: 17599 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGTTT
tgattattggctttgatgtg

SEQ ID NO: 17600 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCACGATT
aagttatacctttcccaatt

SEQ ID NO: 17601 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
tcaggaggctgaggcagaag

SEQ ID NO: 17602 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCGAGATT
actccagcctgggcaacaaa

SEQ ID NO: 17603 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGCTT
acacaagcaaatcctgctat

SEQ ID NO: 17604 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGCTT
tgtaaggctatataaaacta

SEQ ID NO: 17605 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
tagtgtgtgactggatgaat

SEQ ID NO: 17606 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGATT
ccaccttctggatacctgat

SEQ ID NO: 17607 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCAGATT
caactgtgacaagtcaacgt

SEQ ID NO: 17608 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGCTT
agcattttatcccaattttc

SEQ ID NO: 17609 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGCTT
atcccaattttctcctgctt

SEQ ID NO: 17610 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
tttctcctgcttgtaagctt

SEQ ID NO: 17611 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCAGATT
aaacactaattcaaaaagta

SEQ ID NO: 17612 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATACGATT
tattttagactttattgggc

SEQ ID NO: 17613 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGTTT
acgtaaatgaattgacattc

SEQ ID NO: 17614 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
ttgacattcctatgtttgaa

SEQ ID NO: 17615 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
gcatgtgtcatttattcttc

SEQ ID NO: 17616 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGCTT
cacacaataacaggcattgg

SEQ ID NO: 17617 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
aattatattttatttactag

SEQ ID NO: 17618 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGATT
tttgccttaaaatgaatagg

SEQ ID NO: 17619 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGTTT
gaacatctggttacatacca

SEQ ID NO: 17620 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGCTT
atcatgtaaacaataaggca

SEQ ID NO: 17621 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGATT
atcagcatgttcaatgttgg

SEQ ID NO: 17622 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
ctcggagctaaaagcaaata

SEQ ID NO: 17623 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
aatcactatgaaaatctttt

SEQ ID NO: 17624 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
aatcttttcaatgtttccaa

SEQ ID NO: 17625 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGATT
agaaactatgtacttttagt

SEQ ID NO: 17626 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGCTT
aaatctagcatattagagga

SEQ ID NO: 17627 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
atgtgctttaaaaagtcttt

SEQ ID NO: 17628 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
tattgttaagatcagacaac

SEQ ID NO: 17629 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGCTT
tcattgaaattctgtaagcc

SEQ ID NO: 17630 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
aaaaattgtaaaaatattca

SEQ ID NO: 17631 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGATT
tttaagtgcatttgtcaatg

SEQ ID NO: 17632 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
tatcaagatataatcttgcc

SEQ ID NO: 17633 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
gccttttgattcaaattccc

SEQ ID NO: 17634 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGTTT
ttatagaatataatggcaac

SEQ ID NO: 17635 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
aatataatggcaaccttagt

SEQ ID NO: 17636 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGTTT
actcatatggatccatggca

SEQ ID NO: 17637 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGATT
ttttaataccatttcagctg

SEQ ID NO: 17638 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
aaagacctaagtgagaaaaa

SEQ ID NO: 17639 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGTTT
atcaacacaatgataataat

SEQ ID NO: 17640 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGCTT
acacaatgataataatcact

SEQ ID NO: 17641 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGTTT
ttagcatttactgtgttcca

SEQ ID NO: 17642 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
gaacatgttgactcactctt

SEQ ID NO: 17643 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGCTT
ggcagctaaagtaatacttc

SEQ ID NO: 17644 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
gactcaaggaatctgaccaa

SEQ ID NO: 17645 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
accaaagaagattctaaggg

SEQ ID NO: 17646 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
tttcaaataatgcaggatca

SEQ ID NO: 17647 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
cttctggtcttcaaatgtca

SEQ ID NO: 17648 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
caaagatacccaaagttatt

SEQ ID NO: 17649 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGATT
ggtttatgaagagtcataag

SEQ ID NO: 17650 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
tccatagtcaaaaactggca

SEQ ID NO: 17651 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
tctatgtccagttcaaccat

SEQ ID NO: 17652 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
ccattttggtttctcaaaat

SEQ ID NO: 17653 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGCTT
tttctcaaaatagttgtttt

SEQ ID NO: 17654 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTTGTTT
tcaaaatagttgtttttaaa

SEQ ID NO: 17655 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
agcttgtttcattaagtctt

SEQ ID NO: 17656 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGCTT
acaatgatgttgatgatgat

SEQ ID NO: 17657 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGTTT
tatgtcaaagcaatacatcc

SEQ ID NO: 17658 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGATT
gatatgcataattctgaggc

SEQ ID NO: 17659 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
gtgttccatagccataaata

SEQ ID NO: 17660 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGTTT
gaacatggagtcagccattt

SEQ ID NO: 17661 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGTTT
caggcattctaatattgaaa

SEQ ID NO: 17662 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
tctaatattgaaacaaggtt

SEQ ID NO: 17663 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
tattgaaacaaggtttatag

SEQ ID NO: 17664 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGTTT
tgtgatggtaaacaggagaa

SEQ ID NO: 17665 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
tgtttccttaacagagaaat

SEQ ID NO: 17666 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
ccaatatgcatatttttcac

SEQ ID NO: 17667 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGTTT
ggggagagggtagaagccag

SEQ ID NO: 17668 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
agttgtcaccctttgactat

SEQ ID NO: 17669 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGATT
tttgagcgaatatgtaattt

SEQ ID NO: 17670 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGTTT
atcacgtagctctgggttaa

SEQ ID NO: 17671 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGGGTTT
atcacccaacatctgtcttt

SEQ ID NO: 17672 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
ttttgccatgttatcaatgt

SEQ ID NO: 17673 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGATT
catgtgcctatttaaggttg

SEQ ID NO: 17674 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
ttaagaatctgtacagtaaa

SEQ ID NO: 17675 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGTTT
agattattacataccttcca

SEQ ID NO: 17676 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
accttccacagtgtttgtta

SEQ ID NO: 17677 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
tacaacgccttttcttgtgt

SEQ ID NO: 17678 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGCTT
attgtaggtataagataaaa

SEQ ID NO: 17679 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTAGATT
gtgagtaattaaaagtagag

SEQ ID NO: 17680 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGTTT
taggagagctacttaactgt

SEQ ID NO: 17681 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGCTT
tggtaaaatggggataatca

SEQ ID NO: 17682 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTTGCTT
aaaatggggataatcatagt

SEQ ID NO: 17683 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGATT
gtgcttgcttcatattcttg

SEQ ID NO: 17684 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGCTT
atgagataaaaaataaagct

SEQ ID NO: 17685 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGTTT
ctgagtgttcaatttattca

SEQ ID NO: 17686 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGTTT
gagcatatgatgataaatga

SEQ ID NO: 17687 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
actatacaactctagatcta

SEQ ID NO: 17688 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGCTT
actctagatctatcatgttt

SEQ ID NO: 17689 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGATT
atatattttaaatatatatt

SEQ ID NO: 17690 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGTTT
tttttgaaaagtctcgaaaa

SEQ ID NO: 17691 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCAGATT
agtctgtcaaacaagaattt

SEQ ID NO: 17692 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGTTT
acaaattattttccatgtag

SEQ ID NO: 17693 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGTTT
agatgacgttattagttatg

SEQ ID NO: 17694 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
ccatatattgtgccacaatt

SEQ ID NO: 17695 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGTTT
tataagtatccactaattcc

SEQ ID NO: 17696 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGTTT
tccactaattcctctagttt

SEQ ID NO: 17697 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGATT
ctagttttgtagttttcact

SEQ ID NO: 17698 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
cactttaggatttattgtga

SEQ ID NO: 17699 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGTTT
attgcaaaacaaaatgcaag

SEQ ID NO: 17700 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGATT
caaaacaaaatgcaagcaaa

SEQ ID NO: 17701 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGCTT
taatgaaaaataccttgcag

SEQ ID NO: 17702 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGATT
aattgaaatatatgtgtggc

SEQ ID NO: 17703 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
taaatatataagcatgtagc

SEQ ID NO: 17704 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
ataagcatgtagcatatgtt

SEQ ID NO: 17705 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
agacctttggaactgctgta

SEQ ID NO: 17706 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGTTT
ctttggaactgctgtaaaat

SEQ ID NO: 17707 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
gaactgctgtaaaatgattg

SEQ ID NO: 17708 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
gtaaaatgattgttttgctt

SEQ ID NO: 17709 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
aatgattgttttgcttttat

SEQ ID NO: 17710 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGCTT
gcttttatgtttgtttgtgt

SEQ ID NO: 17711 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
caatgcttgcatttcagata

SEQ ID NO: 17712 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
cttgcatttcagatattttg

SEQ ID NO: 17713 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
ttttttaaaaatgaaaacag

SEQ ID NO: 17714 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCCGTTT
caagatctgaaacagacagc

SEQ ID NO: 17715 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGCTT
tagctgagtaaattggggca

SEQ ID NO: 17716 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
ggttgtcataaatactaaat

SEQ ID NO: 17717 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
tgctgttattaacaactcaa

SEQ ID NO: 17718 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
ccgtcataaattgttctcta

SEQ ID NO: 17719 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGATT
acaagtacctttttacaaaa

SEQ ID NO: 17720 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGATT
gatgcctacaacacatagaa

SEQ ID NO: 17721 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGCTT
ggcagcattggtggggacct

SEQ ID NO: 17722 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGCTT
gaaactaaaaagacttgttc

SEQ ID NO: 17723 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGCTT
aactttttatatatcaatcc

SEQ ID NO: 17724 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGCTT
tcagttaaagtgtatttaaa

SEQ ID NO: 17725 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGCTT
aagaggaggaaaaattcaat

SEQ ID NO: 17726 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGCTT
ggatctagttcaatagacat

SEQ ID NO: 17727 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGCTT
ggtaaggtctttgcctcaaa

SEQ ID NO: 17728 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
tgtgtatatcaggagaatct

SEQ ID NO: 17729 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
gagaatcttgtagattttta

SEQ ID NO: 17730 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
tgtagatttttaactagatt

SEQ ID NO: 17731 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
actagatttttagtttagaa

SEQ ID NO: 17732 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGATT
acagaagcaatggttcatct

SEQ ID NO: 17733 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGTTT
agcagggaggcctgagagat

SEQ ID NO: 17734 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGCTT
ggttgggggtggaggatatc

SEQ ID NO: 17735 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGTTT
gtgagtgatactattaccta

SEQ ID NO: 17736 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
aagaaagaagagaaactagt

SEQ ID NO: 17737 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
agaagagaaactagtctaag

SEQ ID NO: 17738 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
tacaatggttctcaggaaca

SEQ ID NO: 17739 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
ggaacattttgcttctgaaa

SEQ ID NO: 17740 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
gaaactataaggtctttcaa

SEQ ID NO: 17741 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGTTT
tccataaatgcctagcgata

SEQ ID NO: 17742 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGATT
catttagcaatttgggtggt

SEQ ID NO: 17743 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGATT
ctttttcttctgatgctgtc

SEQ ID NO: 17744 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGATT
cttctgatgctgtcctctga

SEQ ID NO: 17745 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGCTT
ctcccttttcctctccactg

SEQ ID NO: 17746 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
cctctccactggagagcttc

SEQ ID NO: 17747 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
cttttgattctttttctttc

SEQ ID NO: 17748 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGTTT
tttctttagcacttttagag

SEQ ID NO: 17749 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGTTT
gcacttttagagctcagttt

SEQ ID NO: 17750 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGCTT
actctctgagaggcccataa

SEQ ID NO: 17751 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATCGTTT
atgtcctttaaacatgaaat

SEQ ID NO: 17752 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGCTT
ttttctttacacaatgatca

SEQ ID NO: 17753 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
gaatgcttacaaagtatata

SEQ ID NO: 17754 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
taaactattacatgttatta

SEQ ID NO: 17755 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
acaaattaaatattatatgt

SEQ ID NO: 17756 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
accatgcaataagacagaca

SEQ ID NO: 17757 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGTTT
atcaatagaatcaggcactc

SEQ ID NO: 17758 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
tcaggcactctatggtttaa

SEQ ID NO: 17759 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
cctagtactatccctttaca

SEQ ID NO: 17760 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
tactatccctttacaaaatg

SEQ ID NO: 17761 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGATT
atgtatgtataattttaaaa

SEQ ID NO: 17762 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
atttaatccatcattattct

SEQ ID NO: 17763 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGATT
ttttccaaaatttaaatttt

SEQ ID NO: 17764 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGATT
tcagaatttatctgcattgc

SEQ ID NO: 17765 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
ctaatacattagactccttg

SEQ ID NO: 17766 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
caactgcagtacatttgaaa

SEQ ID NO: 17767 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGATT
actgaagaatctctctggaa

SEQ ID NO: 17768 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
aaaattattttcttaatatc

SEQ ID NO: 17769 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGTTT
gacattaacaaaacatgatg

SEQ ID NO: 17770 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGATT
atattgtatatatatataaa

SEQ ID NO: 17771 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
attatttaatcaattattct

SEQ ID NO: 17772 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
ttaaaaaaacacatagttcc

SEQ ID NO: 17773 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
acactaagtcattgtaggta

SEQ ID NO: 17774 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGATT
agatcacttttcatgcagtg

SEQ ID NO: 17775 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGTTT
ttccacaccagaaatgagga

SEQ ID NO: 17776 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACCGTTT
taccgcagagcctctgttgt

SEQ ID NO: 17777 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGCTT
tttaaatcaaataacagtac

SEQ ID NO: 17778 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
tctgttgaaattctaattct

SEQ ID NO: 17779 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGCTT
tgaaattctaattctttctg

SEQ ID NO: 17780 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
ttctttctgtttagcttctt

SEQ ID NO: 17781 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGTTT
catggcaaccacagccagga

SEQ ID NO: 17782 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAGGTTT
actacgacaaagaagatcat

SEQ ID NO: 17783 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aaattgtcatttgaacaata

SEQ ID NO: 17784 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGTTT
tgacaggcatgagcaaatct

SEQ ID NO: 17785 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
acgaagaatatagcaatgta

SEQ ID NO: 17786 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGATT
tatgcttgtactaaagtcat

SEQ ID NO: 17787 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
gtactaaagtcatgtaagat

SEQ ID NO: 17788 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTCGCTT
tattttcaattaactttttt

SEQ ID NO: 17789 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
ttaactttttttttcgcttt

SEQ ID NO: 17790 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
aaaatagaattttttttcaa

SEQ ID NO: 17791 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGATT
aattttttttcaaaatagtt

SEQ ID NO: 17792 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGATT
ggaaaattaaactgaaggta

SEQ ID NO: 17793 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGTTT
tcttttttttggcataacgt

SEQ ID NO: 17794 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGTTT
catgggtagacacgtgccat

SEQ ID NO: 17795 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGTTGTTT
cactcatgagtgagaacatg

SEQ ID NO: 17796 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
atgagtgagaacatgcgttg

SEQ ID NO: 17797 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGTTT
tgcgttgtttggttttctgt

SEQ ID NO: 17798 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
gtttggttttctgttcctgt

SEQ ID NO: 17799 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGTTT
tgttttagtttgctgagaat

SEQ ID NO: 17800 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGCTT
gtttgctgagaatgatggtt

SEQ ID NO: 17801 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGATT
ttttgggtatatacccagta

SEQ ID NO: 17802 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
aactaatttacactcctacc

SEQ ID NO: 17803 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
ggcatgagatggtatctcat

SEQ ID NO: 17804 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGCTT
ttctctaatggccagtgatg

SEQ ID NO: 17805 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
gtgatgatgagctttttttc

SEQ ID NO: 17806 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGTTT
cacaggtatacatgtgctat

SEQ ID NO: 17807 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGTTT
tccacctatcaacccattat

SEQ ID NO: 17808 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGTTT
cacttatgagtgagaacatg

SEQ ID NO: 17809 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
atgagtgagaacatgcagtg

SEQ ID NO: 17810 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
gtttggttttctcttcctgt

SEQ ID NO: 17811 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGCTT
tgtattagtttgctgaggat

SEQ ID NO: 17812 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGCTT
gtttgctgaggatgatggct

SEQ ID NO: 17813 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
ttaacattgatgggcatttg

SEQ ID NO: 17814 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
gtgcatgtgtctttgtagta

SEQ ID NO: 17815 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTCGTTT
tttgtagtagaatgatttat

SEQ ID NO: 17816 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGATT
gtttcggtatatacccagta

SEQ ID NO: 17817 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
ttcatagcctcaccagaatc

SEQ ID NO: 17818 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
gacttgagatggtatctcat

SEQ ID NO: 17819 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
gagatggtatctcattgtgg

SEQ ID NO: 17820 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGCGTTT
tatctcattgtggttttgat

SEQ ID NO: 17821 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGCTT
tttcttaatgatcactgatg

SEQ ID NO: 17822 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
cactgatgttgagctttttt

SEQ ID NO: 17823 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
cagaaccaatgacaaaaacc

SEQ ID NO: 17824 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
tcaaattgtctctgcaaatg

SEQ ID NO: 17825 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGCTT
gagaataaaatacctaggaa

SEQ ID NO: 17826 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGATT
ccatactgccgaaagtaatt

SEQ ID NO: 17827 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
gacaaaaacaagcaatgtgg

SEQ ID NO: 17828 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGATT
ttatacaaaaattaactcaa

SEQ ID NO: 17829 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGCTT
aatgggatataactaaacta

SEQ ID NO: 17830 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
aattattttaatttttttat

SEQ ID NO: 17831 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
atcattttggtctccttcct

SEQ ID NO: 17832 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
ggaagtctacagttgggagc

SEQ ID NO: 17833 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGCTT
gaaaacagtccatgtgcagg

SEQ ID NO: 17834 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGATT
actcaggaaggcgagagatc

SEQ ID NO: 17835 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGATT
agaaaagataagaaaattat

SEQ ID NO: 17836 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGTTT
taattttggtaataagataa

SEQ ID NO: 17837 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGTTT
atgccattcaaaaatacaat

SEQ ID NO: 17838 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
cttggtactcacctgttggt

SEQ ID NO: 17839 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGGGTTT
aaagctcgtgtagccataat

SEQ ID NO: 17840 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGTTT
ttactgaaaagttacaaact

SEQ ID NO: 17841 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGATT
tatagggggacaatattgaa

SEQ ID NO: 17842 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
attgaataaggattaagaat

SEQ ID NO: 17843 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGTTT
tcaagaaaataagacttgta

SEQ ID NO: 17844 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGCTT
aagataatgtgtacaaatta

SEQ ID NO: 17845 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
gcttacatcctgcacataga

SEQ ID NO: 17846 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGACGTTT
aaaacatggaaattttcaac

SEQ ID NO: 17847 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
tctgtctgtataattcttgg

SEQ ID NO: 17848 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGCTT
tgtctaagttcataaaaatg

SEQ ID NO: 17849 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGTTT
tttctttctaaaattggtgg

SEQ ID NO: 17850 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGATT
cattaaataaatacaatatt

SEQ ID NO: 17851 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGTTT
ttctgggaacagcaacctta

SEQ ID NO: 17852 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGCTT
gtctgcatagggggaaaagc

SEQ ID NO: 17853 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
tacccaagtccaaggaatcc

SEQ ID NO: 17854 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTCGTTT
gaaaaatagactttgtgact

SEQ ID NO: 17855 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGTTT
attatccaaccaacttttgg

SEQ ID NO: 17856 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
aagtaacattttctaccttc

SEQ ID NO: 17857 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGCTT
attcgagcactgtctcaaag

SEQ ID NO: 17858 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGATT
taactgtgaacattttaaag

SEQ ID NO: 17859 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGATT
ataacatcacagactttaat

SEQ ID NO: 17860 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
taaacacgataaataaaatc

SEQ ID NO: 17861 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
ttagttttatgagacctcct

SEQ ID NO: 17862 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAGGATT
tggctacagtgtggtgagag

SEQ ID NO: 17863 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
ggaatttgcatatcatagaa

SEQ ID NO: 17864 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGATT
ttgcatatcatagaaatgag

SEQ ID NO: 17865 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
gaaatgagtttggattttaa

SEQ ID NO: 17866 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGACGTTT
ttctgagaaatgcatcatta

SEQ ID NO: 17867 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
cagtaacataagtgagtaaa

SEQ ID NO: 17868 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGATT
ggagatgacaatgtaatcaa

SEQ ID NO: 17869 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGTTT
atgtaatcaatgcagatttt

SEQ ID NO: 17870 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGCTT
actcttctgtcatttgctgt

SEQ ID NO: 17871 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
cagatctatccttgtatagt

SEQ ID NO: 17872 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGATT
tactcaggtcaaattaaaaa

SEQ ID NO: 17873 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGATT
agactatgaaatcagatatt

SEQ ID NO: 17874 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGCTT
cagatattcttggatttgaa

SEQ ID NO: 17875 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
tatacaatttgagataaaac

SEQ ID NO: 17876 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGTTT
cagataaaacaataaagcct

SEQ ID NO: 17877 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGCTT
tgtaggtgaaaatgtgcatg

SEQ ID NO: 17878 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGATT
atccaaaatattttaataag

SEQ ID NO: 17879 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGTTT
agcaatgcaggtagctcact

SEQ ID NO: 17880 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGCTT
gacattaaattattaagatg

SEQ ID NO: 17881 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
tattaagatggttggcttca

SEQ ID NO: 17882 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGCTT
gaatgcaaagaaaaatgaaa

SEQ ID NO: 17883 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGATT
cttgtgcatattcaaaagtg

SEQ ID NO: 17884 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGAGCTT
aatggtgtgaacccgggagg

SEQ ID NO: 17885 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
ttccacaaaaacttgtacat

SEQ ID NO: 17886 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
gatacaaaaagccatatatt

SEQ ID NO: 17887 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGATT
gtaaatccctagggacagaa

SEQ ID NO: 17888 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGTTT
ggaatgactactaacgggcc

SEQ ID NO: 17889 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
gatcgttgcacaactctgag

SEQ ID NO: 17890 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGTTT
atagtttaaaaaatgagtta

SEQ ID NO: 17891 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGATT
agaattgatattaaatctaa

SEQ ID NO: 17892 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
aatctaatgaagattctggg

SEQ ID NO: 17893 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGATT
tgaagtttttaaattaattt

SEQ ID NO: 17894 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGCTT
gacaacttatgacaattgtg

SEQ ID NO: 17895 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCGGTTT
ttagtagtgaaggccaatat

SEQ ID NO: 17896 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGTTT
aaaacaggaggaagagaata

SEQ ID NO: 17897 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
tcatctgtagcagcataaaa

SEQ ID NO: 17898 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
ccaaaggaaatctacaaatt

SEQ ID NO: 17899 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
gtgagacagtgggttaattt

SEQ ID NO: 17900 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
actttgctataggcaccaga

SEQ ID NO: 17901 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
tataggcaccagaaaatgct

SEQ ID NO: 17902 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
gattatgctcaggttctctg

SEQ ID NO: 17903 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGCTT
caagttcttgtcactctttg

SEQ ID NO: 17904 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGTTT
ctttgaggaaataaaaacca

SEQ ID NO: 17905 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGTTT
gtcttctcttctatctttcc

SEQ ID NO: 17906 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
acttctccctctctctcctg

SEQ ID NO: 17907 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGCTT
gccagccatttgccccatta

SEQ ID NO: 17908 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGATT
ccttactccttgatcttgca

SEQ ID NO: 17909 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGTTT
gcatgattctacacaagcac

SEQ ID NO: 17910 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
caagcacatctgtttctaca

SEQ ID NO: 17911 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGCTT
tctacaatatgttttcttct

SEQ ID NO: 17912 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
cttggcttcattatttatat

SEQ ID NO: 17913 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGATT
tcagagttgtagatcttggt

SEQ ID NO: 17914 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGCTT
agttgtagatcttggtacca

SEQ ID NO: 17915 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGTTT
gtaccagattgctttaaata

SEQ ID NO: 17916 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGATT
gtgtgtgtgtcctttctttt

SEQ ID NO: 17917 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGATT
atctccaaactcagcaggcc

SEQ ID NO: 17918 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGCTT
agaaactgagaagtcatcct

SEQ ID NO: 17919 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
tttctcttaccaaaccacgc

SEQ ID NO: 17920 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGCTT
cacccacacttaaactattt

SEQ ID NO: 17921 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGCTT
cttcttactatcttttagat

SEQ ID NO: 17922 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
taataaacgcaccaataaat

SEQ ID NO: 17923 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGCTT
gaatcaattatgcagtcaaa

SEQ ID NO: 17924 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGATT
gaaacagaagcaaaattcag

SEQ ID NO: 17925 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
gaagaaaataaagaataatg

SEQ ID NO: 17926 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAGGATT
ataatgtacagatttggaag

SEQ ID NO: 17927 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
ttggaagacaggattgtggt

SEQ ID NO: 17928 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
attagctaattgtcatgcat

SEQ ID NO: 17929 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGTTT
attaatttatttatttttga

SEQ ID NO: 17930 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGCGATT
aacctctgcctcccgagttc

SEQ ID NO: 17931 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGGGTTT
ttttgtatttttagtagaga

SEQ ID NO: 17932 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
aaagcgatgaattaaattaa

SEQ ID NO: 17933 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGCTT
gtctcagccaatcacagcag

SEQ ID NO: 17934 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGATT
agcttcagccaaccacagcc

SEQ ID NO: 17935 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGTTT
tgtcaagctataagcaatca

SEQ ID NO: 17936 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGTTT
acagatcccagtgagaaaac

SEQ ID NO: 17937 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGTTT
aaattctccatccattggaa

SEQ ID NO: 17938 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
cattggaaataagtttcaaa

SEQ ID NO: 17939 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGTTT
aaacattttacttcaaaact

SEQ ID NO: 17940 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGCTT
aaaactttcagttttcttgt

SEQ ID NO: 17941 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
taccatgtgggctaggtgtt

SEQ ID NO: 17942 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
ggcaacagcacatatatttg

SEQ ID NO: 17943 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
cacctgggtcaaattatcta

SEQ ID NO: 17944 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
gagacaccatgctaggggat

SEQ ID NO: 17945 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGCTT
ttgtttagagaacattcaat

SEQ ID NO: 17946 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
ggatgttgataaagctgagc

SEQ ID NO: 17947 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
tgataaagctgagcaaatga

SEQ ID NO: 17948 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGATT
ataattaatattatcattat

SEQ ID NO: 17949 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGCTT
tccttttgccagtactgcta

SEQ ID NO: 17950 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGATT
tgctagatagcttagaacca

SEQ ID NO: 17951 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGCTT
atgacccaaattcacactgt

SEQ ID NO: 17952 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGCTT
agcagctttctatatatttg

SEQ ID NO: 17953 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
tatatatttgaatagctttg

SEQ ID NO: 17954 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
atttcattattaaaagagag

SEQ ID NO: 17955 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGCTT
ttcactctctagggtattca

SEQ ID NO: 17956 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
agggtattcattatgctttc

SEQ ID NO: 17957 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGCTT
caagtgaatttcgaaaacat

SEQ ID NO: 17958 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGTTT
atttcgaaaacatttatgct

SEQ ID NO: 17959 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGCTT
cagtcaggatcatgacatca

SEQ ID NO: 17960 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
ggcctgaaaatgggagaaaa

SEQ ID NO: 17961 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGCTT
tctgaatcgaaacaaaaaac

SEQ ID NO: 17962 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGTTT
cctaattcaaaaaaagcctt

SEQ ID NO: 17963 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
ggtttgctattttatatata

SEQ ID NO: 17964 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
aaaataatttttgtaagttc

SEQ ID NO: 17965 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
gtaataattttcaataaaga

SEQ ID NO: 17966 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGATT
agtattttaaaatcaattaa

SEQ ID NO: 17967 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGATT
aacaaaccctcagacaggag

SEQ ID NO: 17968 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
ctcatcctaaagacccatgc

SEQ ID NO: 17969 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGATT
actcaaaggttgacttttga

SEQ ID NO: 17970 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
ttaattaaaattgcataaag

SEQ ID NO: 17971 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGTTT
caaaagatcaaagtcagccc

SEQ ID NO: 17972 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
ctctcacctggaatgactga

SEQ ID NO: 17973 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGAGTTT
ctgtcacatatctgtaatag

SEQ ID NO: 17974 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGCTT
agttggagttatgagtggcc

SEQ ID NO: 17975 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
tcacaccaattacttcttac

SEQ ID NO: 17976 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
ttcttacctgggattacaga

SEQ ID NO: 17977 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGTTT
tcgaagagctgaaacattgc

SEQ ID NO: 17978 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTACGTTT
gcctttagtcaaggtatttt

SEQ ID NO: 17979 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGCTT
gtcaaggtattttctacgtt

SEQ ID NO: 17980 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGATT
aactaacttaatttaattag

SEQ ID NO: 17981 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGATT
cagatattatatattattaa

SEQ ID NO: 17982 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
acttaaatgcgtaaacaact

SEQ ID NO: 17983 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGTTT
gtcagacacaaaaggctgca

SEQ ID NO: 17984 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGTTT
atagagataaaacatagatg

SEQ ID NO: 17985 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
gaagtgactgctaatgagta

SEQ ID NO: 17986 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAAGTTT
ttaggtagtggtgatgttgc

SEQ ID NO: 17987 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
aagaggcagtcttctttgca

SEQ ID NO: 17988 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGATT
gtctaggtggctccagtgaa

SEQ ID NO: 17989 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGATT
ggaaaatagaatatctagat

SEQ ID NO: 17990 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGCTT
gtgtatacaatgcattaatc

SEQ ID NO: 17991 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGTTT
ctgtacttgtatttaaaggc

SEQ ID NO: 17992 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGTGCTT
tttaaaggcctgagtttttt

SEQ ID NO: 17993 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGTTT
gagttttttgtgtgcttctt

SEQ ID NO: 17994 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGCTT
ttagtatttgcctatcaatg

SEQ ID NO: 17995 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
ctatcaatgactagctttca

SEQ ID NO: 17996 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGTTT
tgctggaaaaatcagacccc

SEQ ID NO: 17997 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGATT
ttattggaacactgtgctgc

SEQ ID NO: 17998 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCCGTTT
gcctgagattttcataaatt

SEQ ID NO: 17999 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGATT
tcctacacagaagcctcttg

SEQ ID NO: 18000 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
cctcttgcaaggatttttac

SEQ ID NO: 18001 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGATT
cagtaaaagtgtacctaaac

SEQ ID NO: 18002 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGCTT
atctgcctaaaaatttccta

SEQ ID NO: 18003 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
aagcatataacatgggaagg

SEQ ID NO: 18004 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGTTT
gttattcatggtcataaata

SEQ ID NO: 18005 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTAGCTT
atgatgagcatgctgaataa

SEQ ID NO: 18006 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
tttgaggatgacacttgttg

SEQ ID NO: 18007 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGCTT
tcctaagaaaaaaattctaa

SEQ ID NO: 18008 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGATT
agcaggtgtggcattgaaac

SEQ ID NO: 18009 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGTTT
ggtgtggcattgaaacggaa

SEQ ID NO: 18010 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGTTT
caatttttcacatcaatatc

SEQ ID NO: 18011 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGCTT
ttgagctatttgttagcatg

SEQ ID NO: 18012 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGCTT
atttgttagcatgtattgct

SEQ ID NO: 18013 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGCTT
attttagttataatactaat

SEQ ID NO: 18014 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGATT
tttaaaagggacttaaatta

SEQ ID NO: 18015 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGCTT
attccataagtgtccttttc

SEQ ID NO: 18016 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGCTT
atattaaagcaacctaaagc

SEQ ID NO: 18017 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGGGTTT
aattttatatagggttatca

SEQ ID NO: 18018 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGCTT
tcaggaggtaagtctgtgag

SEQ ID NO: 18019 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
caagaaaacaaatcagagtc

SEQ ID NO: 18020 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
tctttctgcaattgtattga

SEQ ID NO: 18021 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
caggggagggacctggtggt

SEQ ID NO: 18022 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCGGTTT
gtaagtgattggatcatggg

SEQ ID NO: 18023 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGTTT
gtgagttctcatgagatctg

SEQ ID NO: 18024 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGCTT
ctgcaccatgttaagatgtg

SEQ ID NO: 18025 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGATT
tgcttcccctttgccttcga

SEQ ID NO: 18026 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
ctttgccttcgaccatgatt

SEQ ID NO: 18027 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGAGCTT
aatggcgtgaacccgggagg

SEQ ID NO: 18028 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGTTT
tatcataacaggtaatgaaa

SEQ ID NO: 18029 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
agtttgaacaaaaataaggc

SEQ ID NO: 18030 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
cattctcattaaaaactttt

SEQ ID NO: 18031 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
ttattagcaggaaaaaatag

SEQ ID NO: 18032 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
aacattatactaaatttcac

SEQ ID NO: 18033 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
ccatactgcccaaggtaatt

SEQ ID NO: 18034 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
gagaaaaacaagcaatgggg

SEQ ID NO: 18035 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGATT
ttatacaaaaatcaattcaa

SEQ ID NO: 18036 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGCTT
aatgggatctaattaaacta

SEQ ID NO: 18037 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGCGATT
aaccattgtggaagtcagtg

SEQ ID NO: 18038 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
ctataaagacacatgcacac

SEQ ID NO: 18039 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGATT
caaatgtccaacaatgatag

SEQ ID NO: 18040 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
caatgaaaaatttgaaaaag

SEQ ID NO: 18041 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGTTT
tgtccccatagatgaagggc

SEQ ID NO: 18042 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCAGCTT
tagatgaagggcagctgttt

SEQ ID NO: 18043 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGCTT
ctgtttgccagcttccaagt

SEQ ID NO: 18044 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGCTT
tgccagcttccaagtcactg

SEQ ID NO: 18045 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGCTT
tccaagtcactgcttggctt

SEQ ID NO: 18046 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGATT
ttcttttcttctttgggttc

SEQ ID NO: 18047 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACTGTTT
gttgttcaatgagggcaaga

SEQ ID NO: 18048 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGATT
aaactaataataacaacata

SEQ ID NO: 18049 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
aataacaacataaacagatt

SEQ ID NO: 18050 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGCTT
aggtaacatgttctagaatt

SEQ ID NO: 18051 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGATT
tctagaattatcagcttgtt

SEQ ID NO: 18052 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
catctttatactcagaaatt

SEQ ID NO: 18053 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTACGCTT
tatactcagaaatttgaagt

SEQ ID NO: 18054 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATAGCTT
gaaatttgaagtttacgctt

SEQ ID NO: 18055 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
agcaccactctccagcctga

SEQ ID NO: 18056 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
ttcataacatcttgaccagg

SEQ ID NO: 18057 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
ccatctcacgaaaccacttt

SEQ ID NO: 18058 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
aactcattccaatttcctat

SEQ ID NO: 18059 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGATT
tagaatggtgaatcctttcc

SEQ ID NO: 18060 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGCTT
gtaaacagacgtgctgtcat

SEQ ID NO: 18061 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGATT
tatttatagagcacaggcag

SEQ ID NO: 18062 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
gtagatttagtataattctt

SEQ ID NO: 18063 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
taattcttaagagattttct

SEQ ID NO: 18064 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
aataattaaataatataatt

SEQ ID NO: 18065 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
tttctgaacgataaattagc

SEQ ID NO: 18066 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
aagagagtcagcctgttcgt

SEQ ID NO: 18067 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
ttagaccttcattgcaaatc

SEQ ID NO: 18068 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
gcatcttctccattggcact

SEQ ID NO: 18069 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCAGCTT
aatctcatggggtaccgtct

SEQ ID NO: 18070 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGCTT
ccagcttcaaaccttttttt

SEQ ID NO: 18071 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGATT
aattggagttatggccttgc

SEQ ID NO: 18072 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGCTT
agttatggccttgctgtgga

SEQ ID NO: 18073 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
ggccttgctgtggattaggc

SEQ ID NO: 18074 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGTTT
tttctctatatttgcaataa

SEQ ID NO: 18075 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
ctatatttgcaataaggctg

SEQ ID NO: 18076 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
tgtgttcactggagtagcac

SEQ ID NO: 18077 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
gcacatttgatttccttcaa

SEQ ID NO: 18078 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTAGATT
taagtacttagtgcaagagg

SEQ ID NO: 18079 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGCTT
aggcctagattttggcctat

SEQ ID NO: 18080 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGCTT
ctttcaacatgccttcctca

SEQ ID NO: 18081 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGCTT
cctcactaagcttaatcatt

SEQ ID NO: 18082 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGATT
taagcttaatcatttctagc

SEQ ID NO: 18083 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGATT
gaaacagaacacgtcacatt

SEQ ID NO: 18084 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGTTT
cagaacacgtcacatttaat

SEQ ID NO: 18085 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGCTT
tgaaaaaattacgctgacag

SEQ ID NO: 18086 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
atggaaaccaaagttaggat

SEQ ID NO: 18087 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGATT
catatacacattcaaaagta

SEQ ID NO: 18088 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAACGTTT
taaaacatatgtccacacaa

SEQ ID NO: 18089 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGATT
gagccaaaaggccacatacg

SEQ ID NO: 18090 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
cagaggctgggtgtaatagg

SEQ ID NO: 18091 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGCTT
tggttaatggttaaagagta

SEQ ID NO: 18092 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGATT
aatattctaaaactacataa

SEQ ID NO: 18093 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGATT
ctgagtgatacactttaaaa

SEQ ID NO: 18094 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
aaaattgtcctcagaatagg

SEQ ID NO: 18095 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGCTT
caaatcaaagcagttgccac

SEQ ID NO: 18096 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGATT
agcagttgccacttgtgctt

SEQ ID NO: 18097 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGCTT
actgtggctcttgaagaaaa

SEQ ID NO: 18098 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGTTT
gaaaagttggcttgaataac

SEQ ID NO: 18099 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGATT
gcttgaataactggtgtttt

SEQ ID NO: 18100 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCAGTTT
tgtgaactcagatgtccatt

SEQ ID NO: 18101 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGATT
aactcagatgtccattacca

SEQ ID NO: 18102 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGCTT
attaaaggaagacactaagc

SEQ ID NO: 18103 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGATT
tggaagttgaagagaccttg

SEQ ID NO: 18104 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGTTT
atcagatttcatcatcatcc

SEQ ID NO: 18105 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
tcctttcattttactaattt

SEQ ID NO: 18106 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGCTT
attttatagctttgaagaag

SEQ ID NO: 18107 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGTTT
agagcagctttagttggcat

SEQ ID NO: 18108 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGCTT
cagctttagttggcatctga

SEQ ID NO: 18109 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGTTT
cttctggataaacaggccac

SEQ ID NO: 18110 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
gagttttcattagtcaggca

SEQ ID NO: 18111 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
tcattagtcaggcatttagt

SEQ ID NO: 18112 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGATT
tcaggcatttagtttaagat

SEQ ID NO: 18113 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTAGATT
aatcgaaaaagataaagaat

SEQ ID NO: 18114 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGTTT
agatttaatctcataacaat

SEQ ID NO: 18115 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGCTT
tacaatacaaatgacagatg

SEQ ID NO: 18116 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGATT
tttggcctattaatcattag

SEQ ID NO: 18117 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGAGCTT
aatggcgtgaacccaggagg

SEQ ID NO: 18118 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTCGTTT
caaaagccttaaacacgtga

SEQ ID NO: 18119 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGCTT
gaatgtataatgaaataatg

SEQ ID NO: 18120 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGTTT
taaatacacaatgcatttaa

SEQ ID NO: 18121 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
aacaaagtttagccctagtt

SEQ ID NO: 18122 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGATT
tttagccctagttaagagat

SEQ ID NO: 18123 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
aaatttgtacaacgaaaatg

SEQ ID NO: 18124 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
tcaatcaatatttattcttg

SEQ ID NO: 18125 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGATT
ttccacttttattaacatta

SEQ ID NO: 18126 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
gttgcatataaaggcagtac

SEQ ID NO: 18127 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
tgaatgtgttattcttgtat

SEQ ID NO: 18128 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
agacacacacatatatatag

SEQ ID NO: 18129 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGCTT
tatatatagatatgttttat

SEQ ID NO: 18130 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
catgaaaatggtcttatccc

SEQ ID NO: 18131 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
aaaaaaagttatcataaatc

SEQ ID NO: 18132 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGATT
tttctttctagcagagaagt

SEQ ID NO: 18133 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
gtgatgtagatcagaaaaca

SEQ ID NO: 18134 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGATT
agaaaacaagttgattaatc

SEQ ID NO: 18135 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGTTT
ctatgttaaatatgtagcag

SEQ ID NO: 18136 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGATT
agtcatccctctctttcaag

SEQ ID NO: 18137 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
gcctttcttccataaatatt

SEQ ID NO: 18138 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGCTT
acatcaattctgggtaaagg

SEQ ID NO: 18139 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGCTT
tgaaacaaaaaatttcagta

SEQ ID NO: 18140 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGATT
aaatgcatggagttctatat

SEQ ID NO: 18141 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
tttaaaagttccattcttgt

SEQ ID NO: 18142 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAAGATT
ttagagcattaacaatagaa

SEQ ID NO: 18143 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGATT
actaactaaaaagaatgaaa

SEQ ID NO: 18144 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGCTT
aattgacactagaacacaat

SEQ ID NO: 18145 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGATT
atcttttttttttaagttac

SEQ ID NO: 18146 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGTTT
tctaaaacacatagaataca

SEQ ID NO: 18147 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
tgtgaataaaagcaaaggga

SEQ ID NO: 18148 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
ttgaagcagagaggatccac

SEQ ID NO: 18149 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
ttgatgtgttcttcaagtag

SEQ ID NO: 18150 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGTTT
caagtagcagagtttgaatg

SEQ ID NO: 18151 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGTTT
cctctagatcaaaccatgtt

SEQ ID NO: 18152 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGCTT
tatcagtgtaaaagtaatgg

SEQ ID NO: 18153 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGGGATT
tacaaaaattgagaggtaga

SEQ ID NO: 18154 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
ggcagttagtgcatcctggc

SEQ ID NO: 18155 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGCTT
ttacttagaaatgaaaacat

SEQ ID NO: 18156 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
tgagaatggggcagaaagag

SEQ ID NO: 18157 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
cttttttttaaaaaagcggg

SEQ ID NO: 18158 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGCTT
gaagtgattattccctagat

SEQ ID NO: 18159 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
ctttaaagggataaagcaaa

SEQ ID NO: 18160 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGATT
taattttataatagttatta

SEQ ID NO: 18161 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGCTT
agccaaagaaaccaacaaac

SEQ ID NO: 18162 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGCTT
aaactgttctgttaccttca

SEQ ID NO: 18163 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
gcaaacactcaaagttacag

SEQ ID NO: 18164 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGCTT
aagattgtgtcttctacttt

SEQ ID NO: 18165 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGCTT
ttcattgggtgctaccaatg

SEQ ID NO: 18166 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
aatggctggcttgctgaatg

SEQ ID NO: 18167 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGAGCTT
ctgacaccaattcttccata

SEQ ID NO: 18168 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
aataacccacaacacaaaat

SEQ ID NO: 18169 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
aaaattaatgttttattatc

SEQ ID NO: 18170 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGTTT
tctgctgttttccaaaatac

SEQ ID NO: 18171 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGGGCTT
acctaaaaaaatacagatgc

SEQ ID NO: 18172 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
tatctaagtaatgctgaaat

SEQ ID NO: 18173 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
aatactaacgtgaaccctcc

SEQ ID NO: 18174 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGTTT
gagtacacatacatcaatga

SEQ ID NO: 18175 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aaattcaattcaaaaagtag

SEQ ID NO: 18176 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGATT
attcaaaaagtagaaaagtt

SEQ ID NO: 18177 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
aaagtagaaaagtttttgga

SEQ ID NO: 18178 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
agaaaagtttttggattttg

SEQ ID NO: 18179 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGCTT
agctgtgcacctgtagtctc

SEQ ID NO: 18180 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGCTT
ccatgatcacaccactgcgg

SEQ ID NO: 18181 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
ataaaccaaaaagggtaaaa

SEQ ID NO: 18182 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
aagggtaaaaaaaagttttt

SEQ ID NO: 18183 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
aggcatgcagtgctcctcct

SEQ ID NO: 18184 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
aggacaaagatactaaaaga

SEQ ID NO: 18185 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
taaaaaaaatttcattttat

SEQ ID NO: 18186 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGTTT
tttcattttatttgagtttc

SEQ ID NO: 18187 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGCTT
tctatagtttcttcttaatt

SEQ ID NO: 18188 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTCGATT
tgtaaaatctttaatataca

SEQ ID NO: 18189 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGTTT
ttccatacagaacaattcac

SEQ ID NO: 18190 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
atgacataacctctctgagc

SEQ ID NO: 18191 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTAGTTT
acctctctgagcctaagatt

SEQ ID NO: 18192 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGTTT
ttaataatcatgctccgaag

SEQ ID NO: 18193 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
aatcatgctccgaagagtgg

SEQ ID NO: 18194 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGCTT
gtgatggttaactgtatata

SEQ ID NO: 18195 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
tatataaagtgcttaacagg

SEQ ID NO: 18196 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
aacacgtattcatggagctc

SEQ ID NO: 18197 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGCTT
ctcatccttctattttaatt

SEQ ID NO: 18198 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGCTT
ccttgctttggataatttta

SEQ ID NO: 18199 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGATT
tatgagcatgtaatattaaa

SEQ ID NO: 18200 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
catgtaatattaaacagaga

SEQ ID NO: 18201 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGTTT
aagttcaggagctagaaagc

SEQ ID NO: 18202 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGATT
agaaagcctgggttttgaat

SEQ ID NO: 18203 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGATT
acatcccagttaagcaactt

SEQ ID NO: 18204 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGATT
aagagtatccctagaatgac

SEQ ID NO: 18205 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
agaatgactgttgattgctc

SEQ ID NO: 18206 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
aattcccatcatttcacctt

SEQ ID NO: 18207 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGTTT
aaagcaaataaattccaaca

SEQ ID NO: 18208 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
aagaaatattacagtctctc

SEQ ID NO: 18209 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGGGTTT
tctataggatgaggtgggaa

SEQ ID NO: 18210 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
tactccaaactgcagttccc

SEQ ID NO: 18211 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGCTT
ccatataattttgtaatatg

SEQ ID NO: 18212 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGTTT
tgttgtgcttttgtaataat

SEQ ID NO: 18213 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
ccagataattcctttaaaca

SEQ ID NO: 18214 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGTTT
catctcttgtagaaagcaag

SEQ ID NO: 18215 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGTTT
gtagaaagcaagtagtgttt

SEQ ID NO: 18216 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
aaagcaagtagtgtttactt

SEQ ID NO: 18217 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
ttacttgtttgtttctttaa

SEQ ID NO: 18218 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGTTT
acaactctataataatttca

SEQ ID NO: 18219 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGATT
gaagatctgccaaaatctga

SEQ ID NO: 18220 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGCTT
ctaactgttgtaaaatgaaa

SEQ ID NO: 18221 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGATT
gtcacttctctagaaacaca

SEQ ID NO: 18222 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aatcagaacatgagaaccta

SEQ ID NO: 18223 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGCTT
gagaaattgcgacagcctag

SEQ ID NO: 18224 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
ttaataataatgatgtatca

SEQ ID NO: 18225 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
ccataaatctattccaagac

SEQ ID NO: 18226 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGCTT
ttttacacagtacaaaatag

SEQ ID NO: 18227 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGTTT
gagatccattagaaatgctg

SEQ ID NO: 18228 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGCTT
tgcactctcctgggtcagga

SEQ ID NO: 18229 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
tatcttttaagttgttaaat

SEQ ID NO: 18230 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
ttaaggtacaaaaggctgac

SEQ ID NO: 18231 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGATT
taaaagaaatgtatttgact

SEQ ID NO: 18232 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATACGCTT
ctccactctggctgacaagg

SEQ ID NO: 18233 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGTTT
ctgacaaggatacgcttaac

SEQ ID NO: 18234 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
atcaggagagatgagagagg

SEQ ID NO: 18235 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCCGATT
gagtccttcctacacctggc

SEQ ID NO: 18236 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGTTT
atttagtcattgaatagctc

SEQ ID NO: 18237 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAACGATT
ataagaaagtcaaaggtgcg

SEQ ID NO: 18238 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
tgtcagggttacacttataa

SEQ ID NO: 18239 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGATT
tacagcatttatgttccaag

SEQ ID NO: 18240 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAAGCTT
atgaccttggactgttctag

SEQ ID NO: 18241 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGATT
tagttattgtgaacttttct

SEQ ID NO: 18242 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGTTT
agatgtcatatattaatcac

SEQ ID NO: 18243 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
tagtgtttggaaatcctgca

SEQ ID NO: 18244 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGCTT
aataacatcctagggagtct

SEQ ID NO: 18245 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
cactatgggttatcttcaaa

SEQ ID NO: 18246 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGCGTTT
aataaacacaatatttaata

SEQ ID NO: 18247 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
ctgtaatatgggcagaaagt

SEQ ID NO: 18248 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGTTT
aattgccaacattctactta

SEQ ID NO: 18249 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGATT
ttatcttactcttcccctag

SEQ ID NO: 18250 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGATT
tggttgtaatttattatatt

SEQ ID NO: 18251 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
ttcctcactacaacacctca

SEQ ID NO: 18252 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGCTT
ttcacatctcattgatacta

SEQ ID NO: 18253 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGCTT
ttaactattgtccatgaata

SEQ ID NO: 18254 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGCTT
agtgtatctttagcctgtaa

SEQ ID NO: 18255 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
ggaacaaagcagacctgtca

SEQ ID NO: 18256 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
tattctagagtgaaggaatt

SEQ ID NO: 18257 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
tttcatcccagtattggtta

SEQ ID NO: 18258 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
atcccagtattggttacatg

SEQ ID NO: 18259 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTCGTTT
agtattggttacatggtttg

SEQ ID NO: 18260 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGTTT
ttaagttcaggagtacaagt

SEQ ID NO: 18261 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGGGTTT
cataggtaaacttgtgtcat

SEQ ID NO: 18262 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
ggtaaacttgtgtcatgggg

SEQ ID NO: 18263 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGCTT
tgtgtcatgggggtttgttt

SEQ ID NO: 18264 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGTGTTT
tgtatttgaaaggttccagt

SEQ ID NO: 18265 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
aagttaaaaagatgaacgta

SEQ ID NO: 18266 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCTGTTT
tgaagaatattagaataggc

SEQ ID NO: 18267 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGTTT
aaaatgactacacaaagcaa

SEQ ID NO: 18268 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGTTT
actacacaaagcaataaggt

SEQ ID NO: 18269 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGTTT
aagcaataaggtttatgttt

SEQ ID NO: 18270 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGATT
taccattatttgtatatgaa

SEQ ID NO: 18271 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGATT
tattttagtctacaacattt

SEQ ID NO: 18272 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGTTT
aattggtaaagtaattgctc

SEQ ID NO: 18273 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGATT
aagtgaccagccatcaatta

SEQ ID NO: 18274 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTAGTTT
tgctagcacaattaacagaa

SEQ ID NO: 18275 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
atttttctttattaaactac

SEQ ID NO: 18276 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
ccaaaacaaaatgaaggtag

SEQ ID NO: 18277 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGTTT
aatgaaggtagtcttgattt

SEQ ID NO: 18278 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
ctctagttgttacccatttt

SEQ ID NO: 18279 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
tgttgggggggggttgttgt

SEQ ID NO: 18280 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGCTT
tggccttgatccttgtcctc

SEQ ID NO: 18281 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGATT
acctaacttggacttaggaa

SEQ ID NO: 18282 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
caattcctccctcttgtgtt

SEQ ID NO: 18283 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
caggagctgtctccttcatt

SEQ ID NO: 18284 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGATT
atttttggctttgtcatcaa

SEQ ID NO: 18285 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
aaacaagaaaaaaaatcatc

SEQ ID NO: 18286 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGCTT
cttcgatggaatttgaaata

SEQ ID NO: 18287 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGATT
atatatagcttcataaactc

SEQ ID NO: 18288 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGCTT
taaaaattttaaaggatgca

SEQ ID NO: 18289 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
caaccaaagttcctgcattc

SEQ ID NO: 18290 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCAGTTT
ctcaagttccaggttaaatt

SEQ ID NO: 18291 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGTTT
atcccattctctgccactct

SEQ ID NO: 18292 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGCTT
actctacctgtttttcattc

SEQ ID NO: 18293 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
catgcttagcaaccattata

SEQ ID NO: 18294 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
taatgtgtttatgaacatct

SEQ ID NO: 18295 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
ctaatttacatacattttct

SEQ ID NO: 18296 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
tttacatacattttctcatt

SEQ ID NO: 18297 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGATT
ttgtttttatttactaagca

SEQ ID NO: 18298 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGTTT
caaccttcttggaaccaagg

SEQ ID NO: 18299 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAGGTTT
tcagggcagcagggaaggag

SEQ ID NO: 18300 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGCTT
ctcgtatgtgcagttcacaa

SEQ ID NO: 18301 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGTTT
actgtggcctataaacagat

SEQ ID NO: 18302 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGCTT
agatccaggttttatggatc

SEQ ID NO: 18303 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGATT
agggcaaattaggcacaaaa

SEQ ID NO: 18304 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
agacagattaatataaaagt

SEQ ID NO: 18305 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
ctttaggacttcccttcatt

SEQ ID NO: 18306 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGTTT
tgatagttgagcaaatttct

SEQ ID NO: 18307 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGTTT
aaatttctctgagttttaca

SEQ ID NO: 18308 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGTTT
caaatttgggaacacctcca

SEQ ID NO: 18309 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
cctcaatgtagtgatgtatg

SEQ ID NO: 18310 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGTTT
atgaagagtttgttatctca

SEQ ID NO: 18311 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGATT
tatttttcctcaacatattc

SEQ ID NO: 18312 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGATT
tgattcactcttctttataa

SEQ ID NO: 18313 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
tgagaaataatactttttac

SEQ ID NO: 18314 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
ttgctcaatgttaatataat

SEQ ID NO: 18315 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
ttattgctcatccttgtaac

SEQ ID NO: 18316 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGCTT
agtggtgaggccatcatctc

SEQ ID NO: 18317 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGATT
tcatctcctaagcttattca

SEQ ID NO: 18318 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGATT
ggtgaatgaagccaaataaa

SEQ ID NO: 18319 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGATT
gctgggtctgccaaacagcc

SEQ ID NO: 18320 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGTTT
tcattttcctatacagctgc

SEQ ID NO: 18321 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
caacttccaataaatctcca

SEQ ID NO: 18322 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGTTT
tccatttggcttgggacagc

SEQ ID NO: 18323 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
tttggcttgggacagccagt

SEQ ID NO: 18324 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGCTT
ggacagccagtgtttgtttc

SEQ ID NO: 18325 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
ctcttgcttgtaatcaatat

SEQ ID NO: 18326 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGTTT
aacaagctccttttggctat

SEQ ID NO: 18327 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
ttggctatgacagttttgct

SEQ ID NO: 18328 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGATT
taatcacttgacctcagaag

SEQ ID NO: 18329 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGATT
cttatactataaaatagata

SEQ ID NO: 18330 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACTGCTT
aaattcactttaaatataca

SEQ ID NO: 18331 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGTTT
atatcttctacactattatt

SEQ ID NO: 18332 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
catattctgaccataaatgg

SEQ ID NO: 18333 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
tcttaatcttaaaatttact

SEQ ID NO: 18334 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGATT
taaatgatcagtatgtaaat

SEQ ID NO: 18335 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGATGATT
ttcttttctgaaaatttcct

SEQ ID NO: 18336 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGCTT
ttctgaaaatttcctcgatg

SEQ ID NO: 18337 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGTTT
attggctttcattaacagct

SEQ ID NO: 18338 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGCTT
ttaatgagaacatcgtgaag

SEQ ID NO: 18339 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGCTT
cgtgaagtccagcttataag

SEQ ID NO: 18340 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGTTT
ataccatatttcatgacata

SEQ ID NO: 18341 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGATT
aacttgtttttttttatttt

SEQ ID NO: 18342 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGATT
gtttttttttatttttcagg

SEQ ID NO: 18343 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
caatggagggcatcaattaa

SEQ ID NO: 18344 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
accttttcttcagaattaaa

SEQ ID NO: 18345 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGTGCTT
tcagaattaaagtatgattt

SEQ ID NO: 18346 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
attactttactgatatcaga

SEQ ID NO: 18347 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
tgttcatagtcccatttata

SEQ ID NO: 18348 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
gggtctctgcaacaatttct

SEQ ID NO: 18349 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGATT
aaaggaatttttcccccaaa

SEQ ID NO: 18350 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGATT
attctaatttttattacggc

SEQ ID NO: 18351 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGAGCTT
cacaattcaaattaagtcat

SEQ ID NO: 18352 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGATT
tctgaatttctttcaataag

SEQ ID NO: 18353 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
gttgaggaaatcatacatct

SEQ ID NO: 18354 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGCTT
ttgcttagctgttagtattt

SEQ ID NO: 18355 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGTTT
tagtatttgctggcttacat

SEQ ID NO: 18356 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGCTT
aaacaattgtatgctgcaca

SEQ ID NO: 18357 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGTTT
gctgcacaaagagcttcaaa

SEQ ID NO: 18358 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
gagcttcaaaaggagttttt

SEQ ID NO: 18359 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
ttacttgcattttgacattt

SEQ ID NO: 18360 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
agtaattgacccaggaattg

SEQ ID NO: 18361 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGCTT
aagattgaatttgataatct

SEQ ID NO: 18362 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
aaacaagagttgagccaatg

SEQ ID NO: 18363 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
ggatgccaaaaatctaaacg

SEQ ID NO: 18364 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGTTT
aagccacagctgacattata

SEQ ID NO: 18365 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGTTT
aaggtttggggaaatgtgca

SEQ ID NO: 18366 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
ggtcactagagtgggacact

SEQ ID NO: 18367 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGAGTTT
acagggtgatgttcgggact

SEQ ID NO: 18368 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGCTT
tttatcattagcagactttc

SEQ ID NO: 18369 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGTTT
ctggagtgaggcagttattg

SEQ ID NO: 18370 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGATT
ggccactggaatgagaattt

SEQ ID NO: 18371 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGATT
aatgagaatttcacagattt

SEQ ID NO: 18372 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
gctgattttcagagcctgtg

SEQ ID NO: 18373 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGATGATT
tctgagttaatgataaataa

SEQ ID NO: 18374 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGCTT
acctgttcacaacttgaaac

SEQ ID NO: 18375 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
aagcacagtctgagcatgta

SEQ ID NO: 18376 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGATT
tgcagaataacaacaattac

SEQ ID NO: 18377 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGATT
aggtattataagtaatctag

SEQ ID NO: 18378 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
aaagtatacggtaggatgtg

SEQ ID NO: 18379 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGATT
atgtaaagaacttgagcatc

SEQ ID NO: 18380 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGCTT
ttgtaattgtaattttctgc

SEQ ID NO: 18381 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGATT
caaacctgctagaaagagga

SEQ ID NO: 18382 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
tagaaagaggatagggattg

SEQ ID NO: 18383 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGCGATT
tttggctaatgttggcattt

SEQ ID NO: 18384 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTAGTTT
caaaatcattacatacattt

SEQ ID NO: 18385 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGTGCTT
atgggaacatggaggaagaa

SEQ ID NO: 18386 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATCGATT
tcctataggaatgcccccaa

SEQ ID NO: 18387 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGCTT
ttaagctgaggttgagaaac

SEQ ID NO: 18388 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAGGCTT
cttagaccacaatttcacct

SEQ ID NO: 18389 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
ttacttgctcctttggctct

SEQ ID NO: 18390 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
tgctcctttggctctaattg

SEQ ID NO: 18391 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGTTT
taaacggcctgagaggctgg

SEQ ID NO: 18392 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGCTT
tatatcttctgagaggtatt

SEQ ID NO: 18393 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
atccaccaaggctaatcact

SEQ ID NO: 18394 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGATT
gtaatcattccagtgtcatc

SEQ ID NO: 18395 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGCTT
tgtcatccagtgattaagct

SEQ ID NO: 18396 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACTGATT
ctaactcattggaaaatatt

SEQ ID NO: 18397 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
gggtccagaggaaggtagat

SEQ ID NO: 18398 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGATT
aaggtagatgtatgattttg

SEQ ID NO: 18399 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGATT
ttaccaagtgaataaaactg

SEQ ID NO: 18400 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCGGGATT
gctggaaatggcagttgaac

SEQ ID NO: 18401 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGATT
tccagaagtgagatgagcat

SEQ ID NO: 18402 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGATT
ggcctgccaagttaatactc

SEQ ID NO: 18403 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGCTT
atgagaggaaactaggagga

SEQ ID NO: 18404 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
taaatccaattttggacatc

SEQ ID NO: 18405 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
attcctagtcccaagaggct

SEQ ID NO: 18406 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGCTT
catagtacaaaacatggcaa

SEQ ID NO: 18407 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
ggaaacacaaggggttagaa

SEQ ID NO: 18408 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGTTT
taagttacttaactgtgtat

SEQ ID NO: 18409 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
catcggtaaaatgagtatga

SEQ ID NO: 18410 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
agttaaataaactgacacat

SEQ ID NO: 18411 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGCTT
ccaggatacaagagagaaac

SEQ ID NO: 18412 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGCTT
ttgagcagttgtgggagttg

SEQ ID NO: 18413 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
tgggagttgccctgcttcaa

SEQ ID NO: 18414 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGATT
aagaaagatgacaccctcgg

SEQ ID NO: 18415 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGCTT
tgacaccctcggcattgatt

SEQ ID NO: 18416 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGCTT
gttctatacttatgctattt

SEQ ID NO: 18417 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
ctcctctctccataactttt

SEQ ID NO: 18418 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
tttatctgcaacagaacttc

SEQ ID NO: 18419 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAGGATT
cacagctgtgtgtagcagag

SEQ ID NO: 18420 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGTTT
aaaagataacattagaggaa

SEQ ID NO: 18421 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGCTT
aactttaaaatgcagaaata

SEQ ID NO: 18422 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGCTT
gaatttttatcgatgactca

SEQ ID NO: 18423 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
tttggctttattcagcagac

SEQ ID NO: 18424 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGTTT
gtttagaaattcaatcagtg

SEQ ID NO: 18425 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCACGCTT
ccatcaggaacacctagaag

SEQ ID NO: 18426 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGTTT
ctagaagccacgctttgttg

SEQ ID NO: 18427 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGATT
atataatgtatcacagaaaa

SEQ ID NO: 18428 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGTTT
atttaggaaggtgggtgaga

SEQ ID NO: 18429 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGCTT
ggagtccctggcacctgaac

SEQ ID NO: 18430 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTGGCTT
aggaaattataagtccaaat

SEQ ID NO: 18431 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
actcttgtatgaacctgagt

SEQ ID NO: 18432 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGTTT
aggcaggacaagcacctggc

SEQ ID NO: 18433 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGCTT
tagggtttactctacagtat

SEQ ID NO: 18434 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGTTT
atttatatcgactatttgac

SEQ ID NO: 18435 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGTTT
tacaagtgcattttaccaaa

SEQ ID NO: 18436 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGATT
tttaccaaatagtgtttcca

SEQ ID NO: 18437 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGTTT
gattgcaaaactacttttca

SEQ ID NO: 18438 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
tttactttctcaactactac

SEQ ID NO: 18439 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGTTT
ctcaactactactactgatt

SEQ ID NO: 18440 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGCTT
gtttttgaattttttaaaaa

SEQ ID NO: 18441 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAACGTTT
ttagtcctctaatcatatca

SEQ ID NO: 18442 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
gctcactgcagcctccacct

SEQ ID NO: 18443 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGTTT
gcaggcgccacaacacccgg

SEQ ID NO: 18444 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
cacctcagcctcccaaagtg

SEQ ID NO: 18445 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGCTT
tgcaggcatgagccgtcctg

SEQ ID NO: 18446 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
tgagccgtcctgcctggctt

SEQ ID NO: 18447 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGCTT
tggggaacaaatggaaaata

SEQ ID NO: 18448 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGTTT
ataatgacatggtgagttac

SEQ ID NO: 18449 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGATT
atgctctaaaatataaactg

SEQ ID NO: 18450 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGATT
ttttcttaccaaaggtgaca

SEQ ID NO: 18451 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGTTT
aaaggtgacattgagattta

SEQ ID NO: 18452 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGCTT
acattgagatttacaaagtt

SEQ ID NO: 18453 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
gtttggtgcttgttaccaag

SEQ ID NO: 18454 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGCTT
attgaagctatgaccagaag

SEQ ID NO: 18455 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGCTT
ctatgaccagaagtcaggct

SEQ ID NO: 18456 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGCTT
aggctttgagctttgagttc

SEQ ID NO: 18457 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGTTT
attggcaacaatagacctgc

SEQ ID NO: 18458 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGTTT
ctgcagatgttttaaaaggc

SEQ ID NO: 18459 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGAGATT
aagatccaattacaaagtct

SEQ ID NO: 18460 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
aaggaaaaaggaagaggaat

SEQ ID NO: 18461 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
catttctttattattttctt

SEQ ID NO: 18462 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGTTT
tttcattcaggaaatacaag

SEQ ID NO: 18463 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCGGTTT
tcaggaaatacaagaaaggt

SEQ ID NO: 18464 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
ggatattctgatctctctta

SEQ ID NO: 18465 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
acatagggagggttgcagac

SEQ ID NO: 18466 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
tgtttctgcatgtgtggcat

SEQ ID NO: 18467 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGATT
tgtttgtcaaaataataact

SEQ ID NO: 18468 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGATT
tatgttgttcccaagtcttg

SEQ ID NO: 18469 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATCGTTT
atatattgcatttactttaa

SEQ ID NO: 18470 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
tttagaatctttgggctatt

SEQ ID NO: 18471 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGTTT
tgaatgccatatggagatgt

SEQ ID NO: 18472 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTAGCTT
gccaatggtcaactactgca

SEQ ID NO: 18473 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGTTT
aggtgataatatctatagga

SEQ ID NO: 18474 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGCTT
taattaagtgttacaaacat

SEQ ID NO: 18475 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGCTT
cattatggctttaattatag

SEQ ID NO: 18476 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
tttaattatagtgtggctta

SEQ ID NO: 18477 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGATT
gtgtggcttaaactgttttt

SEQ ID NO: 18478 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCACGTTT
gtcagagaaaattttctacc

SEQ ID NO: 18479 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
atctcccaataaatgaattt

SEQ ID NO: 18480 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACAGATT
gcatattcaactttggaaac

SEQ ID NO: 18481 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGCTT
cctttgcatacatccaccac

SEQ ID NO: 18482 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAACGTTT
tccctaccttcatgctgcaa

SEQ ID NO: 18483 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGTTT
tttttagcacatagagtgca

SEQ ID NO: 18484 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGATT
aaaactagcattctttcaac

SEQ ID NO: 18485 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACCGATT
ttggtgaggtgaaaaaagag

SEQ ID NO: 18486 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
accgatttttttgtcatata

SEQ ID NO: 18487 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTTGTTT
atttttttgtcatatacttt

SEQ ID NO: 18488 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATAGATT
ttgttttataggaaaaaaat

SEQ ID NO: 18489 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
aacctatttagaattctaat

SEQ ID NO: 18490 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGCTT
ttcaaaaagaaaacagaagt

SEQ ID NO: 18491 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGCTT
aggcttcacatataaaaacc

SEQ ID NO: 18492 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGCTT
ttgatattttatagaactag

SEQ ID NO: 18493 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGTTT
aatgcttgtattttcaaaat

SEQ ID NO: 18494 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
tgtattttcaaaatagaagt

SEQ ID NO: 18495 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
gtttttgattgatacaaaat

SEQ ID NO: 18496 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGATT
aaatatttattttatttcaa

SEQ ID NO: 18497 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
aagtcaagcaagagggaacc

SEQ ID NO: 18498 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGATT
attaagaactatgagaaaga

SEQ ID NO: 18499 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
gaacctgatttgaattgcag

SEQ ID NO: 18500 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CACGGTTT
atgtctttacttctctaaac

SEQ ID NO: 18501 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGTTT
ctactcaagaggctgagaca

SEQ ID NO: 18502 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGCTT
tcaagaggctgagacaggat

SEQ ID NO: 18503 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGAGATT
cactcagcctgggagacaga

SEQ ID NO: 18504 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGTTT
gcctgggagacagagtgaga

SEQ ID NO: 18505 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGCTT
atgtacaaatcattttatgt

SEQ ID NO: 18506 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGATT
caattctttacttgtgagat

SEQ ID NO: 18507 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
tctttttacaggaatccaaa

SEQ ID NO: 18508 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGCTT
tcaaaatatgacattaataa

SEQ ID NO: 18509 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTCGCTT
taaggacttgtaatttgtac

SEQ ID NO: 18510 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
ttcaagtcatccgccattag

SEQ ID NO: 18511 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGCTT
tgtttaaccttgcaagagta

SEQ ID NO: 18512 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGATT
cacaatgaaatttcctgctg

SEQ ID NO: 18513 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
tccccacaacaaataatcta

SEQ ID NO: 18514 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGATT
ccatcactgacatcatagct

SEQ ID NO: 18515 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGCTT
tgtcctttgttatctttgcc

SEQ ID NO: 18516 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAAGCTT
tttttctcgaggaactaaat

SEQ ID NO: 18517 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGATT
agacctcatgaaagaaataa

SEQ ID NO: 18518 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCTGATT
aaagaaataaattagatttg

SEQ ID NO: 18519 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGCTT
tgtgtataagatgggtatct

SEQ ID NO: 18520 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
aatgaatcaagacatatata

SEQ ID NO: 18521 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGATT
ctttcacagaatctctattt

SEQ ID NO: 18522 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGTTT
tagatcaggagtgggcagag

SEQ ID NO: 18523 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGCTT
ggagtgggcagaggcaggtt

SEQ ID NO: 18524 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGGGTTT
aacaaaaaaaagtagggaaa

SEQ ID NO: 18525 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
aaaagtagggaaaaggggtt

SEQ ID NO: 18526 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGCTT
ctgttgaagatgaaggtatt

SEQ ID NO: 18527 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGTTT
agagaatatcttctaacgat

SEQ ID NO: 18528 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
tatcatgttaggaagaaagc

SEQ ID NO: 18529 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTAGCTT
attactgaaaaacaactgaa

SEQ ID NO: 18530 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGCTT
tgtctcattctcctgctcct

SEQ ID NO: 18531 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGATT
cttttatttatctcagcaaa

SEQ ID NO: 18532 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGTTT
gctgggaaaaaatatgtatc

SEQ ID NO: 18533 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
gggactgcagagatacctgc

SEQ ID NO: 18534 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
agaaaaacagacatttgcac

SEQ ID NO: 18535 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
agttttgagaaaagcattta

SEQ ID NO: 18536 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGTGTTT
tgatgctgaactaataagaa

SEQ ID NO: 18537 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
ttttatttttttgagtattc

SEQ ID NO: 18538 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGTTT
aagctcttgacacccagggg

SEQ ID NO: 18539 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
tgatgtacctcatgtacaag

SEQ ID NO: 18540 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
gtacctcatgtacaagatgt

SEQ ID NO: 18541 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
atttagaatgcctctcaact

SEQ ID NO: 18542 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGCTT
atggcaagatggtaggttct

SEQ ID NO: 18543 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACGGTTT
taccaccttagcacatgtgt

SEQ ID NO: 18544 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGATT
ttagcacatgtgtaacggtt

SEQ ID NO: 18545 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
ttattttaacccgctcattt

SEQ ID NO: 18546 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGATT
aacatctaatcaacaagggc

SEQ ID NO: 18547 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
atcaaccctaaaccctttcc

SEQ ID NO: 18548 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGTTT
tcacaatggtctccaagtct

SEQ ID NO: 18549 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGCTT
tcttctgttaaaaaatcatc

SEQ ID NO: 18550 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGCTT
aaaatcatcagtggcttctc

SEQ ID NO: 18551 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGATT
cagtggcttctcaatagctt

SEQ ID NO: 18552 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGAGTTT
cttccctcaggagccagtcc

SEQ ID NO: 18553 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCGTGCTT
aattagccgggcgtggtggc

SEQ ID NO: 18554 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATCGCTT
tcggaaggctgaggcaggag

SEQ ID NO: 18555 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGAGATT
gaatcgcttgaacccaggag

SEQ ID NO: 18556 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGATT
caaacaaaaaactcctctca

SEQ ID NO: 18557 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
ttcaatttatgcattgaacc

SEQ ID NO: 18558 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
tcaggaggctgaggcagaag

SEQ ID NO: 18559 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGATT
gaggcggaggttgtggcgag

SEQ ID NO: 18560 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGCTT
taaaaaataaaataaaatta

SEQ ID NO: 18561 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACTGCTT
accaaaaacatttacaaaat

SEQ ID NO: 18562 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGATT
ttccttatactacaaaaatt

SEQ ID NO: 18563 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGCTT
atggataatttaccagtaat

SEQ ID NO: 18564 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGATT
tcaagctttttatgtaagga

SEQ ID NO: 18565 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGCTT
tgtctgggcattctgccttt

SEQ ID NO: 18566 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGTTT
tgtgtgtaatgtccccacca

SEQ ID NO: 18567 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGATT
ctggtccatcccttcatctc

SEQ ID NO: 18568 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAAGTTT
ttcagaaatttaagaatatg

SEQ ID NO: 18569 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
aaatttaagaatatgagaag

SEQ ID NO: 18570 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGATT
gtcacttttaacttagtcat

SEQ ID NO: 18571 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGTTT
taacttagtcatcaatgatt

SEQ ID NO: 18572 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCGGCTT
ttaagtatatgtattacatc

SEQ ID NO: 18573 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGCTT
taaaacattattttaacaaa

SEQ ID NO: 18574 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGTTT
gacacttaagacattcatat

SEQ ID NO: 18575 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGATT
catatctaagttttaaaaaa

SEQ ID NO: 18576 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGCTT
aaaatctgatttggcgacac

SEQ ID NO: 18577 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
agtcagaaacattttcctta

SEQ ID NO: 18578 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGTTT
tatcaaccacacaattactt

SEQ ID NO: 18579 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
catacaacttatcatgaaaa

SEQ ID NO: 18580 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGTTT
gatatgtgtcaaaggtgaaa

SEQ ID NO: 18581 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGATT
ttaatcactttatctaatgg

SEQ ID NO: 18582 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCTGATT
tgctctggttcagctgagca

SEQ ID NO: 18583 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
ctgattacatttcctgactt

SEQ ID NO: 18584 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGATT
agctggtggagaattccctg

SEQ ID NO: 18585 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTAGATT
gtcattagtcttgggggttg

SEQ ID NO: 18586 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGATT
gctaactttaattactatag

SEQ ID NO: 18587 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGATT
tttccccaaattcttaccct

SEQ ID NO: 18588 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGATT
ccaaattcttacccttcttg

SEQ ID NO: 18589 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGTTT
attggaaacaaatctcatta

SEQ ID NO: 18590 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
caacctgataccatctaaga

SEQ ID NO: 18591 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
ttaaattcaagtatagtgtg

SEQ ID NO: 18592 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGCGTTT
tccctattgtcttcattcta

SEQ ID NO: 18593 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGATT
ctattataatgtgaatgaca

SEQ ID NO: 18594 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGATT
gtagataaatctatactact

SEQ ID NO: 18595 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGATGATT
catggatttatctgacttat

SEQ ID NO: 18596 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
ttaaagactgttctattcaa

SEQ ID NO: 18597 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGCTT
gttctattcaataaagtttt

SEQ ID NO: 18598 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAAGCTT
tagaaatattatttaggaaa

SEQ ID NO: 18599 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGCTT
caatcattaattaaagtaca

SEQ ID NO: 18600 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGATT
ccttcattagactcttaatg

SEQ ID NO: 18601 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
actcttaatgaactgattaa

SEQ ID NO: 18602 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGATT
cattcaactgaaaacgggtc

SEQ ID NO: 18603 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGCTT
gcaagtgagatgtgccttgt

SEQ ID NO: 18604 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGTGTTT
ttgttagtgctttttaactt

SEQ ID NO: 18605 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
ttgaagttgttcaaataata

SEQ ID NO: 18606 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGATT
aataaactgttttctctaaa

SEQ ID NO: 18607 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGTTT
gatcgatatctttccattgt

SEQ ID NO: 18608 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGCTT
aatttcttttgaaaaaagat

SEQ ID NO: 18609 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGTTT
aaaatacaaaaatagtgagt

SEQ ID NO: 18610 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAAGTTT
atttagttgcctaacaccaa

SEQ ID NO: 18611 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAGGTTT
catgtctttggtctgtcata

SEQ ID NO: 18612 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGTTT
aacctgatgctgacagcctc

SEQ ID NO: 18613 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTACGTTT
tacattccagctacattatt

SEQ ID NO: 18614 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
cataatgttccctttatctg

SEQ ID NO: 18615 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGATT
cagtttcaactatcctgatc

SEQ ID NO: 18616 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGCTT
actatcctgatcacctgatt

SEQ ID NO: 18617 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGCTT
aaatataaattcaacccttc

SEQ ID NO: 18618 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTCTGCTT
ctctttctcccatatctcca

SEQ ID NO: 18619 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCGGATT
gctgccagcagtcccctaaa

SEQ ID NO: 18620 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGCTT
ggatttttatcctacttcta

SEQ ID NO: 18621 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGATT
catcacgcctgtctccttca

SEQ ID NO: 18622 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
gcacatcatataaaattgtt

SEQ ID NO: 18623 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
ttattatttaacaaaatttt

SEQ ID NO: 18624 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGATT
ttacaataatccataactat

SEQ ID NO: 18625 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAGGATT
gctgatatgtgcaaaaaata

SEQ ID NO: 18626 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACCTGTTT
ataaggattctgctattaca

SEQ ID NO: 18627 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGCTT
tacaatttaaaaacaacact

SEQ ID NO: 18628 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
ttaaaaacaacactatctgc

SEQ ID NO: 18629 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTAGCTT
atctgcttaggtttaattaa

SEQ ID NO: 18630 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
cagccataaacaggaaggtt

SEQ ID NO: 18631 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
acaatatggtggacaccaac

SEQ ID NO: 18632 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGATT
aaagtttaaaattctctaat

SEQ ID NO: 18633 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGTTT
atttgggattacacaaatcc

SEQ ID NO: 18634 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGTTT
aacaaagcgatcaagtattt

SEQ ID NO: 18635 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGATT
gcacagatacaatcctagat

SEQ ID NO: 18636 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
aacttaatttttgccattaa

SEQ ID NO: 18637 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGTTT
tttgccattaaaatagttta

SEQ ID NO: 18638 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGCTT
ttaaaatagtttatgcagtt

SEQ ID NO: 18639 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGATT
aacagggagaagctatactg

SEQ ID NO: 18640 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
ttaacctattccaagaaaat

SEQ ID NO: 18641 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGTTT
tatatatatacatactgaca

SEQ ID NO: 18642 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAACGTTT
acttcataatttgatattta

SEQ ID NO: 18643 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGTTT
tattgaaatattcattattt

SEQ ID NO: 18644 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGATT
tcattattttcttgtttgcc

SEQ ID NO: 18645 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCAGTTT
atttcttttttttttctttt

SEQ ID NO: 18646 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTGGTTT
ttaactttgtctttactaaa

SEQ ID NO: 18647 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGTTT
atttacctttttgtgcatat

SEQ ID NO: 18648 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCAGTTT
atatgttttcccattgggag

SEQ ID NO: 18649 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGATT
tgggaaacataggcctagaa

SEQ ID NO: 18650 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GACAGATT
tgagattttttttttttttt

SEQ ID NO: 18651 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTGGATT
gctcactataacctctgcct

SEQ ID NO: 18652 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGATT
aacctctgcctcctggattc

SEQ ID NO: 18653 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGGGTTT
ttttgtatttttagtagcga

SEQ ID NO: 18654 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGATT
cgccttggcctcccaaaatg

SEQ ID NO: 18655 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGTTT
gccactgcgcctggccaaaa

SEQ ID NO: 18656 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGCTT
tcttgtctgaggctgggtga

SEQ ID NO: 18657 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGTTT
ctctgcctcttttcttttct

SEQ ID NO: 18658 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
tactgtacaacattttttta

SEQ ID NO: 18659 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGAAGTTT
ttatttagatttttgtataa

SEQ ID NO: 18660 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
ctctacatttttacacacat

SEQ ID NO: 18661 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
catattttagaggaactatt

SEQ ID NO: 18662 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGTTT
tgaaaagttaggtccaaatt

SEQ ID NO: 18663 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
aaaataattctctcactctt

SEQ ID NO: 18664 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
accccttgtgtatccatcca

SEQ ID NO: 18665 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
caaataataccctatataaa

SEQ ID NO: 18666 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGCTT
ataaagctacttctttttat

SEQ ID NO: 18667 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGTTT
cccacactgtagaacattta

SEQ ID NO: 18668 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
gctacaataattatcttctc

SEQ ID NO: 18669 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAGGTTT
ttaagttcaggggtacatgc

SEQ ID NO: 18670 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGGGTTT
acacagggaaacttgtgtta

SEQ ID NO: 18671 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
taagtgaggacattctcttg

SEQ ID NO: 18672 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
cggtattttatttgtaagac

SEQ ID NO: 18673 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTGCGTTT
ttgctgagtcataattgtat

SEQ ID NO: 18674 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGAGATT
tccatttgtaaccagagcag

SEQ ID NO: 18675 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGCTT
tttgtaaccagagcagctga

SEQ ID NO: 18676 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTAGCTT
cactcctcactagtcaagaa

SEQ ID NO: 18677 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGCTT
tccattctttggccatcgaa

SEQ ID NO: 18678 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGCTT
tggccatcgaataaagcttg

SEQ ID NO: 18679 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGGGATT
gctctccccaaacaatgtgt

SEQ ID NO: 18680 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATTGTTT
tccccaaacaatgtgtcagg

SEQ ID NO: 18681 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCGGATT
tgcctcagcctcctgagtag

SEQ ID NO: 18682 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACAGGTTT
tttttgtacctttagtagag

SEQ ID NO: 18683 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTCAGCTT
acctcatgtgatccacccat

SEQ ID NO: 18684 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGTTT
aacttcttaattcttatcat

SEQ ID NO: 18685 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGCTT
ttcatatcctcagatgccat

SEQ ID NO: 18686 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGTGTTT
ccacttttttaatagactat

SEQ ID NO: 18687 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGCTT
actcttaacaaaataataaa

SEQ ID NO: 18688 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGTTT
tatacaatacaaatattttt

SEQ ID NO: 18689 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
tacaaatatttttgtaagtt

SEQ ID NO: 18690 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
tatttttgtaagtttgctgt

SEQ ID NO: 18691 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
agtttgctgtttttgtttct

SEQ ID NO: 18692 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTAGTTT
ttttgtttcttttggtttat

SEQ ID NO: 18693 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
aatcctttctccagtggctc

SEQ ID NO: 18694 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGGGTTT
gtacttcataagtgtgatga

SEQ ID NO: 18695 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGTTT
aaaaagaaaacaaaaccttc

SEQ ID NO: 18696 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGTTT
accttcacatgttttcttct

SEQ ID NO: 18697 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGTTT
atgttttcttctagcagttt

SEQ ID NO: 18698 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGATT
gtttgtatgttattttaaat

SEQ ID NO: 18699 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCAGATT
tgtacaatttcccaactaga

SEQ ID NO: 18700 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGGGATT
aatttctatttttattttca

SEQ ID NO: 18701 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
tctttttttaatacctcttc

SEQ ID NO: 18702 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCCTGATT
atacttttcattaaatactt

SEQ ID NO: 18703 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
aaataattattatttcttag

SEQ ID NO: 18704 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGTTT
cttaatttggtagatggcaa

SEQ ID NO: 18705 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGATT
atagggactatttctaaatt

SEQ ID NO: 18706 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGTGATT
attctatgattattaaaata

SEQ ID NO: 18707 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGTTT
cttttaaaatatagtattcc

SEQ ID NO: 18708 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGTTT
tcctcaagtttataagaaat

SEQ ID NO: 18709 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGCTT
tcaggaggctgaggcaggag

SEQ ID NO: 18710 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTGGATT
agaactgcttgaacccggga

SEQ ID NO: 18711 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
agaaaaaaaaaaaaagaaat

SEQ ID NO: 18712 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGATT
gtgtattaccctgggaaaac

SEQ ID NO: 18713 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAACGTTT
caacatttgctggcatatct

SEQ ID NO: 18714 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
ccacttccctcaaaacatca

SEQ ID NO: 18715 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
aactttggcaccaggcagac

SEQ ID NO: 18716 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGTTT
ggcagacttaggtttgaatt

SEQ ID NO: 18717 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATGGTTT
aagttatcatgtagaataga

SEQ ID NO: 18718 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAAGATT
cctaggctaaataaataaca

SEQ ID NO: 18719 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGTTT
atgtggagtatatttgttac

SEQ ID NO: 18720 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGTTT
cctatgttttatcttgccaa

SEQ ID NO: 18721 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATGGCTT
tttatcttgccaaacatgtt

SEQ ID NO: 18722 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGCTT
atgggttcacatcccatctc

SEQ ID NO: 18723 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGCTT
acatcccatctctactgctt

SEQ ID NO: 18724 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGTGATT
tacattgtaactgttattat

SEQ ID NO: 18725 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGATT
attttagcaactttcttcta

SEQ ID NO: 18726 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
gttcttaggaacgagaatat

SEQ ID NO: 18727 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGCTT
atttgcttactttataatag

SEQ ID NO: 18728 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGGAGCTT
tacaaaaccttttcttctta

SEQ ID NO: 18729 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGCTT
aatattttaaagactaaaat

SEQ ID NO: 18730 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
gtcctgccaatacaaagttc

SEQ ID NO: 18731 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGCTT
cagtgtctacaggatgtggg

SEQ ID NO: 18732 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAGGTTT
tatataaattcttaaatcca

SEQ ID NO: 18733 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGATT
ctgaacacaccgaggatgtt

SEQ ID NO: 18734 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aataaatgtggcaagtgcat

SEQ ID NO: 18735 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
aggactgagcagaattatgc

SEQ ID NO: 18736 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGCTT
ttatgcaaaagtttaaaata

SEQ ID NO: 18737 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
agccagcaagatacaaggaa

SEQ ID NO: 18738 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGAGGATT
aaaatgctctagcatgagtc

SEQ ID NO: 18739 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
aaaactagtgacatctactc

SEQ ID NO: 18740 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
cataagatttttgatgaaga

SEQ ID NO: 18741 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTGGTTT
ttagcaaaggaagggggtaa

SEQ ID NO: 18742 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
tggtttgaggagtctaaagg

SEQ ID NO: 18743 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGAGTTT
agtactatggtataaataac

SEQ ID NO: 18744 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGTTT
atgttcatagatatgacttc

SEQ ID NO: 18745 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGATT
ctctctcttggaactaaagg

SEQ ID NO: 18746 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
atatgatgaaactcatgtga

SEQ ID NO: 18747 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAGGATT
tcagaacctcacagatataa

SEQ ID NO: 18748 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGTGTTT
caaatttatattccagaagg

SEQ ID NO: 18749 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
aggaagtgttttgcctaaac

SEQ ID NO: 18750 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGAGGCTT
taggaatataactttgacca

SEQ ID NO: 18751 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTGGATT
atataactttgaccaggagg

SEQ ID NO: 18752 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGCTT
tcacaacaattcaatgacaa

SEQ ID NO: 18753 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGAGTTT
gcaaaatttacttagtgacc

SEQ ID NO: 18754 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGCTT
ataaatagtcaccatttttc

SEQ ID NO: 18755 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAGGATT
cctaggggacttaacctcca

SEQ ID NO: 18756 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGTTT
ataaacactaaccttaaaac

SEQ ID NO: 18757 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGATT
tactaaaaattaacagagag

SEQ ID NO: 18758 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTTGCTT
cagagagaggagatttttga

SEQ ID NO: 18759 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAAGATT
cttgctttattaaaataaat

SEQ ID NO: 18760 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGCTT
cttgaccgttgagaaaacaa

SEQ ID NO: 18761 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
ctttcttactcattaattca

SEQ ID NO: 18762 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTGGATT
aagccttgtaaaatggtctg

SEQ ID NO: 18763 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCTTGTTT
acaactacagcacaatgaat

SEQ ID NO: 18764 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGATT
ctacagcacaatgaatcctt

SEQ ID NO: 18765 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTAGGATT
cttgtttgatttaatcatat

SEQ ID NO: 18766 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
gtatatttatacaacaactc

SEQ ID NO: 18767 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGATT
tagggaaaaatcttcgagac

SEQ ID NO: 18768 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGATT
caaaagaaaaaaagagctga

SEQ ID NO: 18769 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGATT
ttgcaaatcatatatctgat

SEQ ID NO: 18770 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCAGATT
tcctcaacaaaaaataaaca

SEQ ID NO: 18771 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAGGATT
caagcagattaaaaatgaac

SEQ ID NO: 18772 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
ttcacacttggtcggatggt

SEQ ID NO: 18773 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATTGTTT
ggaagagaggagtgtggagt

SEQ ID NO: 18774 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCGAGTTT
gagtcattgtttaatagtta

SEQ ID NO: 18775 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGTTT
ttgtttaatagttaccgagt

SEQ ID NO: 18776 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGCTT
ggtgatcgtgtacaacatga

SEQ ID NO: 18777 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCGTGTTT
ataaatttttaaattcacta

SEQ ID NO: 18778 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCTGTTT
acatgcggtgtctccttggt

SEQ ID NO: 18779 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAAGTTT
atattactgtactcccacca

SEQ ID NO: 18780 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTGGTTT
aaacttctcaaacatttttt

SEQ ID NO: 18781 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGTTT
cccatgctggtaattttagc

SEQ ID NO: 18782 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGCTT
aatcaagaaaaaccctcatc

SEQ ID NO: 18783 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGTTT
gctgtctgtatttcaaccat

SEQ ID NO: 18784 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCTTGCTT
tatttcaaccatgctggttt

SEQ ID NO: 18785 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGGGCTT
taaatacatcaaatatgcct

SEQ ID NO: 18786 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCTGTTT
tgccttagggcttttgcaat

SEQ ID NO: 18787 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGATT
attgctgttttttgtgacta

SEQ ID NO: 18788 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
tgtgactagaatgattcttc

SEQ ID NO: 18789 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTAGTTT
tcagttgtttagctagctcc

SEQ ID NO: 18790 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCCTGTTT
ctccttctctcaattctctg

SEQ ID NO: 18791 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
ctcaattctctgtcctgttt

SEQ ID NO: 18792 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
aaagagggaaggaaagaagg

SEQ ID NO: 18793 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGCCGCTT
ctggcctggagggactcagc

SEQ ID NO: 18794 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAATGATT
gaggccaactagaccggatc

SEQ ID NO: 18795 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGCTT
aagataaatcagttggaaat

SEQ ID NO: 18796 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGTTT
gttggaaatttcagctttaa

SEQ ID NO: 18797 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAAAGTTT
taagcatatctgtcactgtc

SEQ ID NO: 18798 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTAAGATT
catgcatgctgtcacaaata

SEQ ID NO: 18799 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGTTT
tatctgttgatgatcatttg

SEQ ID NO: 18800 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGATT
acagaagtgcatatatctct

SEQ ID NO: 18801 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCTGATT
gtgcatatatctctttgaga

SEQ ID NO: 18802 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGCTT
acattcccaccaacagtgga

SEQ ID NO: 18803 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGATT
cagccatcttaacaggtgtg

SEQ ID NO: 18804 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
accaatccacaaatcactaa

SEQ ID NO: 18805 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGTTT
aactcaagggccaaatttcc

SEQ ID NO: 18806 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
ataaacataatgtaaaataa

SEQ ID NO: 18807 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACTGTTT
aaaataaattagttttccaa

SEQ ID NO: 18808 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGATT
agtcttcatgacaataagta

SEQ ID NO: 18809 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
atgacaataagtactgtgat

SEQ ID NO: 18810 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTTTGCTT
tcttatcctgcacaagatca

SEQ ID NO: 18811 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGTTT
tcaacgtgtgtaacttcatt

SEQ ID NO: 18812 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATAGTTT
ggtgctggccaccatgcctg

SEQ ID NO: 18813 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGGGGTTT
tgtattttttttagtagaga

SEQ ID NO: 18814 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCTGGATT
ctgcctcagccttccaaagt

SEQ ID NO: 18815 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTCAGTTT
ggggaaggcctttttcccat

SEQ ID NO: 18816 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGTTGTTT
gtcatccatctttctttttt

SEQ ID NO: 18817 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACATGATT
gttttctattagctgtaatt

SEQ ID NO: 18818 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTATGTTT
agctgtaattacatgattta

SEQ ID NO: 18819 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGATT
gtaattacatgatttagtat

SEQ ID NO: 18820 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGCTT
agggttaaacatatttgata

SEQ ID NO: 18821 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
caaacgtattcttggaatat

SEQ ID NO: 18822 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCAAGTTT
aaaagaaatgtgtatgttat

SEQ ID NO: 18823 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAGGATT
ctcacctcaaatggtggtca

SEQ ID NO: 18824 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGCTT
cataattgctggccttgcac

SEQ ID NO: 18825 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATTGCTT
tcgggaggctgaggcaggag

SEQ ID NO: 18826 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGATT
aaaaaaaaaaaaagaatgca

SEQ ID NO: 18827 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCTGTTT
catgtgtaagacactaaagt

SEQ ID NO: 18828 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTGTGCTT
ttgaactcaaatttatttat

SEQ ID NO: 18829 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGATT
aaagtctgtcagctgatctc

SEQ ID NO: 18830 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCAAGTTT
cctacctgaattaccatgag

SEQ ID NO: 18831 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAAAGATT
ttccatgcaaagatcattta

SEQ ID NO: 18832 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGCTT
ttgaaagaatagtcatttag

SEQ ID NO: 18833 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGATT
aattttaatttttttgtaga

SEQ ID NO: 18834 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGGGATT
agcctcggcctcccaaagtg

SEQ ID NO: 18835 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCCTGTTT
gaaacatttttctcattttt

SEQ ID NO: 18836 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CATGGATT
ttccctgttttactcatctg

SEQ ID NO: 18837 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGATT
catatttttaaaataattac

SEQ ID NO: 18838 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGCTT
aatgggctgagcgcggtggc

SEQ ID NO: 18839 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGAGATT
ggcgggcggatcactaggtc

SEQ ID NO: 18840 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CGGAGCTT
aatggtgtgaacccaggacg

SEQ ID NO: 18841 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGTTT
ttttattaaaaatcttatgg

SEQ ID NO: 18842 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCATGCTT
tttaatacttatattttaat

SEQ ID NO: 18843 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGTTT
attttccaattatttgtact

SEQ ID NO: 18844 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGCTT
tgaacaatcctaggtgcaat

SEQ ID NO: 18845 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGATT
gagctttattgtattttgat

SEQ ID NO: 18846 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAAAGCTT
gtattttgataaatgattca

SEQ ID NO: 18847 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTAGGTTT
aaattacagttaaagtaacg

SEQ ID NO: 18848 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
agaaacaacaacaacatatt

SEQ ID NO: 18849 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACGGTTT
ttaaaaagagacgtggaaag

SEQ ID NO: 18850 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGCAGATT
gtcaattcaaacttgtctgt

SEQ ID NO: 18851 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTATGCTT
tcaaacttgtctgtggcaga

SEQ ID NO: 18852 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAGGGTTT
catttttcctcaccacccag

SEQ ID NO: 18853 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GATGGCTT
acctttagctgccaagagct

SEQ ID NO: 18854 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATCAGTTT
gctacataaaaaaatcatta

SEQ ID NO: 18855 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTTGTTT
caaatgttaatagcaaaact

SEQ ID NO: 18856 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GTTTGTTT
tgttaatagcaaaactagtt

SEQ ID NO: 18857 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGAAGTTT
gacacaatcatttatgagca

SEQ ID NO: 18858 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAATGCTT
ctctctgaaccttccttaga

SEQ ID NO: 18859 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CTATGTTT
aactgagctcacataagcat

SEQ ID NO: 18860 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACAGATT
ctcaaatttctgttagatga

SEQ ID NO: 18861 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTAGATT
aaacctaacaaggttatcat

SEQ ID NO: 18862 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTAGTTT
ttggagtcacttataaccat

SEQ ID NO: 18863 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AAATGCTT
catgatattgtaaaaatact

SEQ ID NO: 18864 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TCATGTTT
aaaaaatagaatcacaaaat

SEQ ID NO: 18865 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATATGCTT
aattcatgtttccagggtta

SEQ ID NO: 18866 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTGAGATT
caaaacaaaaaaacctcgag

SEQ ID NO: 18867 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAAAGTTT
aaaaacctcgagttgagatt

SEQ ID NO: 18868 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGTTT
gaaaaggccttaaagagtgc

SEQ ID NO: 18869 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATGTGTTT
ttaaagagtgctattgtttc

SEQ ID NO: 18870 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGTTT
gctaattggtctctgtgttg

SEQ ID NO: 18871 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAATGTTT
ttttaaatgcagttgtgagc

SEQ ID NO: 18872 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TATTGCTT
tgttaggggagacaggatgg

SEQ ID NO: 18873 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GAGAGATT
gggagaaaattacagaagtg

SEQ ID NO: 18874 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GCAGGATT
agattgatatggaggctgtg

SEQ ID NO: 18875 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGTTT
agacgtatgatgaaatagaa

SEQ ID NO: 18876 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATAAGATT
aatagaaataagtttgggag

SEQ ID NO: 18877 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGGTGATT
ataaggaagagagcaatcaa

SEQ ID NO: 18878 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CAGAGTTT
tgggaggaaagaatctgaga

SEQ ID NO: 18879 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AATAGATT
ggaatagaaattggataaaa

SEQ ID NO: 18880 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: GGTTGATT
tccttgccacagagaaagtg

SEQ ID NO: 18881 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TACTGATT
atattaaataaatagaaccc

SEQ ID NO: 18882 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTTGTTT
ttgctcttctgaatttattt

SEQ ID NO: 18883 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTTGCTT
tttatttatttgtttatcta

SEQ ID NO: 18884 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: CCATGATT
gcattaccacagaagggctc

SEQ ID NO: 18885 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGATGCTT
cctaggggaaaggaggccca

SEQ ID NO: 18886 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AGTGGCTT
actgagtcccacaactgcac

SEQ ID NO: 18887 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TAGAGTTT
atcaaataccatattctgtc

SEQ ID NO: 18888 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ACTAGCTT
cgacacagggatcagataag

SEQ ID NO: 18889 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: AACAGTTT
gaagaatttgcaataaaatg

SEQ ID NO: 18890 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: ATTGGATT
ataaaatgaacagtttaata

SEQ ID NO: 18891 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TTTGGTTT
tgaacagtttaataattgga

SEQ ID NO: 18892 - DNA, 20 bp, synthetic construct
  source 1..20: mol_type = other DNA; note = Description of Artificial Sequence: Synthetic oligonucleotide; note = Target: SCN9A; (+) strand; PAM type: NNNNGHTT; PAM sequence: TGCAGTTT
tttaataattggatttggtt
